United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 2

SEQ ID NO: 2568 - DNA, 201 bp, Homo sapiens
ctgcataaacagggttcctgagctcactgaaaagactattgtgccttaggaaaagcatttgctgtgtttcgttagcatctggctccaggacagaccttcarcttccaaattggatactgctgccaagaagttgctctgaagtcagtttctatcattctgctctttgattcaaagcactgtttctctcactgggcctccaac

SEQ ID NO: 2569 - DNA, 187 bp, Homo sapiens
catttatgtctcagaccactattcttaactattcaatggtgagcagactgcaaatctgcctgataggacccatattcccacagcactaattcaacatataycttactgagagcatgttttatcattaccattaagaagttaaatgaacatcagaatttaaaatcataaatataatctaatacacttt

SEQ ID NO: 2570 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgagtccagcctagggtgaatgtttccccctccaagaaggggcccttgcagcaccacaacctgcttgtctgccacgtgacggattt

SEQ ID NO: 2571 - DNA, 201 bp, Homo sapiens
aaacagggttcctgagctcactgaaaagactattgtgccttaggaaaagcatttgctgtgtttcgttagcatctggctccaggacagaccttcaacttccmaattggatactgctgccaagaagttgctctgaagtcagtttctatcattctgctctttgattcaaagcactgtttctctcactgggcctccaaccatgtt

SEQ ID NO: 2572 - DNA, 201 bp, Homo sapiens
aatggggcctgttacacatgacactcttctgaattgactgtatttcagtgagctgcccccaaatcaagtttagtgccctcatccatttatgtctcagaccrctattcttaactattcaatggtgagcagactgcaaatctgcctgataggacccatattcccacagcactaattcaacatataccttactgagagcatgtt

SEQ ID NO: 2573 - DNA, 201 bp, Homo sapiens; identical to SEQ ID NO: 2480

SEQ ID NO: 2574 - DNA, 201 bp, Homo sapiens; identical to SEQ ID NO: 2481

SEQ ID NO: 2575 - DNA, 201 bp, Homo sapiens; identical to SEQ ID NO: 2482

SEQ ID NO: 2576 - DNA, 153 bp, Homo sapiens; identical to SEQ ID NO: 2483

SEQ ID NO: 2577 - DNA, 201 bp, Homo sapiens; identical to SEQ ID NO: 2484

SEQ ID NO: 2578 - DNA, 201 bp, Homo sapiens; identical to SEQ ID NO: 2485

SEQ ID NO: 2579 - DNA, 201 bp, Homo sapiens; identical to SEQ ID NO: 2486

SEQ ID NO: 2580 - DNA, 201 bp, Homo sapiens; identical to SEQ ID NO: 2487

SEQ ID NO: 2581 - DNA, 201 bp, Homo sapiens; identical to SEQ ID NO: 2488

SEQ ID NO: 2582 - DNA, 201 bp, Homo sapiens; identical to SEQ ID NO: 2489

SEQ ID NO: 2583 - DNA, 201 bp, Homo sapiens; identical to SEQ ID NO: 2490

SEQ ID NO: 2584 - DNA, 201 bp, Homo sapiens; identical to SEQ ID NO: 2491

SEQ ID NO: 2585 - DNA, 201 bp, Homo sapiens; identical to SEQ ID NO: 2492

SEQ ID NO: 2586 - DNA, 201 bp, Homo sapiens; identical to SEQ ID NO: 2493

SEQ ID NO: 2587 - DNA, 201 bp, Homo sapiens; identical to SEQ ID NO: 2494

SEQ ID NO: 2588 - DNA, 201 bp, Homo sapiens; identical to SEQ ID NO: 2495

SEQ ID NO: 2589 - DNA, 201 bp, Homo sapiens; identical to SEQ ID NO: 2496

SEQ ID NO: 2590 - DNA, 201 bp, Homo sapiens; identical to SEQ ID NO: 2497

SEQ ID NO: 2591 - DNA, 201 bp, Homo sapiens; identical to SEQ ID NO: 2498

SEQ ID NO: 2592 - DNA, 201 bp, Homo sapiens
catctgtggagtgggcatcttcatgcacaggaggagcaagaaaggtgagaaagcctgcaggttcaacgaggatctgcataaacagggttcctgagctcacygaaaagactattgtgccttaggaaaagcatttgctgtgtttcgttagcatctggctccaggacagaccttcaacttccaaattggatactgctgccaaga

SEQ ID NO: 2593 - DNA, 201 bp, Homo sapiens; identical to SEQ ID NO: 2500

SEQ ID NO: 2594 - DNA, 201 bp, Homo sapiens; identical to SEQ ID NO: 2501

SEQ ID NO: 2595 - DNA, 201 bp, Homo sapiens; identical to SEQ ID NO: 2502

SEQ ID NO: 2596 - DNA, 201 bp, Homo sapiens; identical to SEQ ID NO: 2503

SEQ ID NO: 2597 - DNA, 201 bp, Homo sapiens; identical to SEQ ID NO: 2504

SEQ ID NO: 2598 - DNA, 201 bp, Homo sapiens; identical to SEQ ID NO: 2505

SEQ ID NO: 2599 - DNA, 201 bp, Homo sapiens; identical to SEQ ID NO: 2506

SEQ ID NO: 2600 - DNA, 201 bp, Homo sapiens
atgcacaggaggagcaagaaaggtgagaaagcctgcaggttcaacgaggatctgcataaacagggttcctgagctcactgaaaagactattgtgccttagraaaagcatttgctgtgtttcgttagcatctggctccaggacagaccttcaacttccaaattggatactgctgccaagaagttgctctgaagtcagtttct

SEQ ID NO: 2601 - DNA, 201 bp, Homo sapiens; identical to SEQ ID NO: 2508

SEQ ID NO: 2602 - DNA, 201 bp, Homo sapiens
gcacaggaggagcaagaaaggtgagaaagcctgcaggttcaacgaggatctgcataaacagggttcctgagctcactgaaaagactattgtgccttaggamaagcatttgctgtgtttcgttagcatctggctccaggacagaccttcaacttccaaattggatactgctgccaagaagttgctctgaagtcagtttctat

SEQ ID NO: 2603 - DNA, 201 bp, Homo sapiens; identical to SEQ ID NO: 2510

SEQ ID NO: 2604 - DNA, 201 bp, Homo sapiens; identical to SEQ ID NO: 2511

SEQ ID NO: 2605 - DNA, 201 bp, Homo sapiens; identical to SEQ ID NO: 2512

SEQ ID NO: 2606 - DNA, 148 bp, Homo sapiens; identical to SEQ ID NO: 2513

SEQ ID NO: 2607 - DNA, 201 bp, Homo sapiens; identical to SEQ ID NO: 2514

SEQ ID NO: 2608 - DNA, 201 bp, Homo sapiens; identical to SEQ ID NO: 2515

SEQ ID NO: 2609 - DNA, 201 bp, Homo sapiens; identical to SEQ ID NO: 2516

SEQ ID NO: 2610 - DNA, 201 bp, Homo sapiens; identical to SEQ ID NO: 2517

SEQ ID NO: 2611 - DNA, 201 bp, Homo sapiens; identical to SEQ ID NO: 2518

SEQ ID NO: 2612 - DNA, 201 bp, Homo sapiens; identical to SEQ ID NO: 2519

SEQ ID NO: 2613 - DNA, 201 bp, Homo sapiens
tgggcatcttcatgcacaggaggagcaagaaaggtgagaaagcctgcaggttcaacgaggatctgcataaacagggttcctgagctcactgaaaagactawtgtgccttaggaaaagcatttgctgtgtttcgttagcatctggctccaggacagaccttcaacttccaaattggatactgctgccaagaagttgctctga

SEQ ID NO: 2614 - DNA, 201 bp, Homo sapiens
gctcatcatctgtggagtgggcatcttcatgcacaggaggagcaagaaaggtgagaaagcctgcaggttcaacgaggatctgcataaacagggttcctgasctcactgaaaagactattgtgccttaggaaaagcatttgctgtgtttcgttagcatctggctccaggacagaccttcaacttccaaattggatactgctg

SEQ ID NO: 2615 - DNA, 201 bp, Homo sapiens; identical to SEQ ID NO: 2522

SEQ ID NO: 2616 - DNA, 201 bp, Homo sapiens; identical to SEQ ID NO: 2523

SEQ ID NO: 2617 - DNA, 201 bp, Homo sapiens; identical to SEQ ID NO: 2524

SEQ ID NO: 2618 - DNA, 201 bp, Homo sapiens; identical to SEQ ID NO: 2525

SEQ ID NO: 2619 - DNA, 201 bp, Homo sapiens; identical to SEQ ID NO: 2526

SEQ ID NO: 2620 - DNA, 201 bp, Homo sapiens; identical to SEQ ID NO: 2527

SEQ ID NO: 2621 - DNA, 201 bp, Homo sapiens; identical to SEQ ID NO: 2528

SEQ ID NO: 2622 - DNA, 201 bp, Homo sapiens; identical to SEQ ID NO: 2529

SEQ ID NO: 2623 - DNA, 201 bp, Homo sapiens; identical to SEQ ID NO: 2530

SEQ ID NO: 2624 - DNA, 201 bp, Homo sapiens
aggtgagaaagcctgcaggttcaacgaggatctgcataaacagggttcctgagctcactgaaaagactattgtgccttaggaaaagcatttgctgtgtttygttagcatctggctccaggacagaccttcaacttccaaattggatactgctgccaagaagttgctctgaagtcagtttctatcattctgctctttgattc

SEQ ID NO: 2625 - DNA, 201 bp, Homo sapiens; identical to SEQ ID NO: 2532

SEQ ID NO: 2626 - DNA, 201 bp, Homo sapiens
agaaagcctgcaggttcaacgaggatctgcataaacagggttcctgagctcactgaaaagactattgtgccttaggaaaagcatttgctgtgtttcgttarcatctggctccaggacagaccttcaacttccaaattggatactgctgccaagaagttgctctgaagtcagtttctatcattctgctctttgattcaaagc

SEQ ID NO: 2627 - DNA, 201 bp, Homo sapiens; identical to SEQ ID NO: 2534

SEQ ID NO: 2628 - DNA, 201 bp, Homo sapiens; identical to SEQ ID NO: 2535

SEQ ID NO: 2629 - DNA, 201 bp, Homo sapiens; identical to SEQ ID NO: 2536

SEQ ID NO: 2630 - DNA, 201 bp, Homo sapiens; identical to SEQ ID NO: 2537

SEQ ID NO: 2631 - DNA, 201 bp, Homo sapiens; identical to SEQ ID NO: 2538

SEQ ID NO: 2632 - DNA, 201 bp, Homo sapiens; identical to SEQ ID NO: 2539

SEQ ID NO: 2633 - DNA, 201 bp, Homo sapiens
aagcctgcaggttcaacgaggatctgcataaacagggttcctgagctcactgaaaagactattgtgccttaggaaaagcatttgctgtgtttcgttagcayctggctccaggacagaccttcaacttccaaattggatactgctgccaagaagttgctctgaagtcagtttctatcattctgctctttgattcaaagcact

SEQ ID NO: 2634 - DNA, 201 bp, Homo sapiens; identical to SEQ ID NO: 2541

SEQ ID NO: 2635 - DNA, 201 bp, Homo sapiens
tgcaggttcaacgaggatctgcataaacagggttcctgagctcactgaaaagactattgtgccttaggaaaagcatttgctgtgtttcgttagcatctggytccaggacagaccttcaacttccaaattggatactgctgccaagaagttgctctgaagtcagtttctatcattctgctctttgattcaaagcactgtttc

SEQ ID NO: 2636 - DNA, 201 bp, Homo sapiens; identical to SEQ ID NO: 2543

SEQ ID NO: 2637 - DNA, 201 bp, Homo sapiens; identical to SEQ ID NO: 2544

SEQ ID NO: 2638 - DNA, 201 bp, Homo sapiens; identical to SEQ ID NO: 2545

SEQ ID NO: 2639 - DNA, 201 bp, Homo sapiens; identical to SEQ ID NO: 2546

SEQ ID NO: 2640 - DNA, 201 bp, Homo sapiens; identical to SEQ ID NO: 2547

SEQ ID NO: 2641 - DNA, 201 bp, Homo sapiens; identical to SEQ ID NO: 2548

SEQ ID NO: 2642 - DNA, 201 bp, Homo sapiens; identical to SEQ ID NO: 2549

SEQ ID NO: 2643 - DNA, 201 bp, Homo sapiens; identical to SEQ ID NO: 2550

SEQ ID NO: 2644 - DNA, 201 bp, Homo sapiens; identical to SEQ ID NO: 2551

SEQ ID NO: 2645 - DNA, 201 bp, Homo sapiens; identical to SEQ ID NO: 2552

SEQ ID NO: 2646 - DNA, 201 bp, Homo sapiens; identical to SEQ ID NO: 2553

SEQ ID NO: 2647 - DNA, 201 bp, Homo sapiens; identical to SEQ ID NO: 2554

SEQ ID NO: 2648 - DNA, 201 bp, Homo sapiens; identical to SEQ ID NO: 2555

SEQ ID NO: 2649 - DNA, 201 bp, Homo sapiens; identical to SEQ ID NO: 2556

SEQ ID NO: 2650 - DNA, 201 bp, Homo sapiens; identical to SEQ ID NO: 2557

SEQ ID NO: 2651 - DNA, 201 bp, Homo sapiens; identical to SEQ ID NO: 2558

SEQ ID NO: 2652 - DNA, 201 bp, Homo sapiens; identical to SEQ ID NO: 2559

SEQ ID NO: 2653 - DNA, 201 bp, Homo sapiens; identical to SEQ ID NO: 2560

SEQ ID NO: 2654 - DNA, 201 bp, Homo sapiens; identical to SEQ ID NO: 2561

SEQ ID NO: 2655 - DNA, 201 bp, Homo sapiens; identical to SEQ ID NO: 2562

SEQ ID NO: 2656 - DNA, 201 bp, Homo sapiens; identical to SEQ ID NO: 2563

SEQ ID NO: 2657 - DNA, 201 bp, Homo sapiens; identical to SEQ ID NO: 2564

SEQ ID NO: 2658 - DNA, 201 bp, Homo sapiens; identical to SEQ ID NO: 2565

SEQ ID NO: 2659 - DNA, 201 bp, Homo sapiens; identical to SEQ ID NO: 2566

SEQ ID NO: 2660 - DNA, 201 bp, Homo sapiens; identical to SEQ ID NO: 2567

SEQ ID NO: 2661 - DNA, 201 bp, Homo sapiens; identical to SEQ ID NO: 2568

SEQ ID NO: 2662 - DNA, 187 bp, Homo sapiens; identical to SEQ ID NO: 2569

SEQ ID NO: 2663 - DNA, 201 bp, Homo sapiens; identical to SEQ ID NO: 2570

SEQ ID NO: 2664 - DNA, 201 bp, Homo sapiens; identical to SEQ ID NO: 2571

SEQ ID NO: 2665 - DNA, 201 bp, Homo sapiens; identical to SEQ ID NO: 2572

SEQ ID NO: 2666 - DNA, 201 bp, Homo sapiens; identical to SEQ ID NO: 2480

SEQ ID NO: 2667 - DNA, 201 bp, Homo sapiens; identical to SEQ ID NO: 2481

SEQ ID NO: 2668 - DNA, 201 bp, Homo sapiens; identical to SEQ ID NO: 2482

SEQ ID NO: 2669 - DNA, 153 bp, Homo sapiens; identical to SEQ ID NO: 2483

SEQ ID NO: 2670 - DNA, 201 bp, Homo sapiens; identical to SEQ ID NO: 2484

SEQ ID NO: 2671 - DNA, 201 bp, Homo sapiens; identical to SEQ ID NO: 2485

SEQ ID NO: 2672 - DNA, 201 bp, Homo sapiens; identical to SEQ ID NO: 2486

SEQ ID NO: 2673 - DNA, 201 bp, Homo sapiens; identical to SEQ ID NO: 2487

SEQ ID NO: 2674 - DNA, 201 bp, Homo sapiens; identical to SEQ ID NO: 2488

SEQ ID NO: 2675 - DNA, 201 bp, Homo sapiens; identical to SEQ ID NO: 2489

SEQ ID NO: 2676 - DNA, 201 bp, Homo sapiens; identical to SEQ ID NO: 2490

SEQ ID NO: 2677 - DNA, 201 bp, Homo sapiens; identical to SEQ ID NO: 2491

SEQ ID NO: 2678 - DNA, 201 bp, Homo sapiens; identical to SEQ ID NO: 2492

SEQ ID NO: 2679 - DNA, 201 bp, Homo sapiens; identical to SEQ ID NO: 2493

SEQ ID NO: 2680 - DNA, 201 bp, Homo sapiens; identical to SEQ ID NO: 2494

SEQ ID NO: 2681 - DNA, 201 bp, Homo sapiens; identical to SEQ ID NO: 2495

SEQ ID NO: 2682 - DNA, 201 bp, Homo sapiens; identical to SEQ ID NO: 2496

SEQ ID NO: 2683 - DNA, 201 bp, Homo sapiens; identical to SEQ ID NO: 2497

SEQ ID NO: 2684 - DNA, 201 bp, Homo sapiens; identical to SEQ ID NO: 2498

SEQ ID NO: 2685 - DNA, 201 bp, Homo sapiens; identical to SEQ ID NO: 2499

SEQ ID NO: 2686 - DNA, 201 bp, Homo sapiens; identical to SEQ ID NO: 2500

SEQ ID NO: 2687 - DNA, 201 bp, Homo sapiens; identical to SEQ ID NO: 2501

SEQ ID NO: 2688 - DNA, 201 bp, Homo sapiens; identical to SEQ ID NO: 2502

SEQ ID NO: 2689 - DNA, 201 bp, Homo sapiens; identical to SEQ ID NO: 2503

SEQ ID NO: 2690 - DNA, 201 bp, Homo sapiens; identical to SEQ ID NO: 2504

SEQ ID NO: 2691 - DNA, 201 bp, Homo sapiens; identical to SEQ ID NO: 2505

SEQ ID NO: 2692 - DNA, 201 bp, Homo sapiens; identical to SEQ ID NO: 2506

SEQ ID NO: 2693 - DNA, 201 bp, Homo sapiens; identical to SEQ ID NO: 2507

SEQ ID NO: 2694 - DNA, 201 bp, Homo sapiens; identical to SEQ ID NO: 2508

SEQ ID NO: 2695 - DNA, 201 bp, Homo sapiens; identical to SEQ ID NO: 2509

SEQ ID NO: 2696 - DNA, 201 bp, Homo sapiens; identical to SEQ ID NO: 2510

SEQ ID NO: 2697 - DNA, 201 bp, Homo sapiens; identical to SEQ ID NO: 2511

SEQ ID NO: 2698 - DNA, 201 bp, Homo sapiens; identical to SEQ ID NO: 2512

SEQ ID NO: 2699 - DNA, 148 bp, Homo sapiens; identical to SEQ ID NO: 2513

SEQ ID NO: 2700 - DNA, 201 bp, Homo sapiens; identical to SEQ ID NO: 2514

SEQ ID NO: 2701 - DNA, 201 bp, Homo sapiens; identical to SEQ ID NO: 2515

SEQ ID NO: 2702 - DNA, 201 bp, Homo sapiens; identical to SEQ ID NO: 2516

SEQ ID NO: 2703 - DNA, 201 bp, Homo sapiens; identical to SEQ ID NO: 2517

SEQ ID NO: 2704 - DNA, 201 bp, Homo sapiens; identical to SEQ ID NO: 2518

SEQ ID NO: 2705 - DNA, 201 bp, Homo sapiens; identical to SEQ ID NO: 2519

SEQ ID NO: 2706 - DNA, 201 bp, Homo sapiens; identical to SEQ ID NO: 2520

SEQ ID NO: 2707 - DNA, 201 bp, Homo sapiens; identical to SEQ ID NO: 2521

SEQ ID NO: 2708 - DNA, 201 bp, Homo sapiens; identical to SEQ ID NO: 2522

SEQ ID NO: 2709 - DNA, 201 bp, Homo sapiens; identical to SEQ ID NO: 2523

SEQ ID NO: 2710 - DNA, 201 bp, Homo sapiens; identical to SEQ ID NO: 2524

SEQ ID NO: 2711 - DNA, 201 bp, Homo sapiens; identical to SEQ ID NO: 2525

SEQ ID NO: 2712 - DNA, 201 bp, Homo sapiens; identical to SEQ ID NO: 2526

SEQ ID NO: 2713 - DNA, 201 bp, Homo sapiens; identical to SEQ ID NO: 2527

SEQ ID NO: 2714 - DNA, 201 bp, Homo sapiens; identical to SEQ ID NO: 2528

SEQ ID NO: 2715 - DNA, 201 bp, Homo sapiens; identical to SEQ ID NO: 2529

SEQ ID NO: 2716 - DNA, 201 bp, Homo sapiens; identical to SEQ ID NO: 2530

SEQ ID NO: 2717 - DNA, 201 bp, Homo sapiens; identical to SEQ ID NO: 2531

SEQ ID NO: 2718 - DNA, 201 bp, Homo sapiens; identical to SEQ ID NO: 2532

SEQ ID NO: 2719 - DNA, 201 bp, Homo sapiens; identical to SEQ ID NO: 2533

SEQ ID NO: 2720 - DNA, 201 bp, Homo sapiens; identical to SEQ ID NO: 2534

SEQ ID NO: 2721 - DNA, 201 bp, Homo sapiens; identical to SEQ ID NO: 2535

SEQ ID NO: 2722 - DNA, 201 bp, Homo sapiens; identical to SEQ ID NO: 2536

SEQ ID NO: 2723 - DNA, 201 bp, Homo sapiens; identical to SEQ ID NO: 2537

SEQ ID NO: 2724 - DNA, 201 bp, Homo sapiens; identical to SEQ ID NO: 2538

SEQ ID NO: 2725 - DNA, 201 bp, Homo sapiens; identical to SEQ ID NO: 2539

SEQ ID NO: 2726 - DNA, 201 bp, Homo sapiens; identical to SEQ ID NO: 2540

SEQ ID NO: 2727 - DNA, 201 bp, Homo sapiens; identical to SEQ ID NO: 2541

SEQ ID NO: 2728 - DNA, 201 bp, Homo sapiens; identical to SEQ ID NO: 2542

SEQ ID NO: 2729 - DNA, 201 bp, Homo sapiens; identical to SEQ ID NO: 2543

SEQ ID NO: 2730 - DNA, 201 bp, Homo sapiens; identical to SEQ ID NO: 2544

SEQ ID NO: 2731 - DNA, 201 bp, Homo sapiens; identical to SEQ ID NO: 2545

SEQ ID NO: 2732 - DNA, 201 bp, Homo sapiens; identical to SEQ ID NO: 2546

SEQ ID NO: 2733 - DNA, 201 bp, Homo sapiens; identical to SEQ ID NO: 2547

SEQ ID NO: 2734 - DNA, 201 bp, Homo sapiens; identical to SEQ ID NO: 2548

SEQ ID NO: 2735 - DNA, 201 bp, Homo sapiens; identical to SEQ ID NO: 2549

SEQ ID NO: 2736 - DNA, 201 bp, Homo sapiens; identical to SEQ ID NO: 2550

SEQ ID NO: 2737 - DNA, 201 bp, Homo sapiens; identical to SEQ ID NO: 2551

SEQ ID NO: 2738 - DNA, 201 bp, Homo sapiens; identical to SEQ ID NO: 2552

SEQ ID NO: 2739 - DNA, 201 bp, Homo sapiens; identical to SEQ ID NO: 2553

SEQ ID NO: 2740 - DNA, 201 bp, Homo sapiens; identical to SEQ ID NO: 2554

SEQ ID NO: 2741 - DNA, 201 bp, Homo sapiens; identical to SEQ ID NO: 2555

SEQ ID NO: 2742 - DNA, 201 bp, Homo sapiens; identical to SEQ ID NO: 2556

SEQ ID NO: 2743 - DNA, 201 bp, Homo sapiens; identical to SEQ ID NO: 2557

SEQ ID NO: 2744 - DNA, 201 bp, Homo sapiens; identical to SEQ ID NO: 2558

SEQ ID NO: 2745 - DNA, 201 bp, Homo sapiens; identical to SEQ ID NO: 2559

SEQ ID NO: 2746 - DNA, 201 bp, Homo sapiens; identical to SEQ ID NO: 2560

SEQ ID NO: 2747 - DNA, 201 bp, Homo sapiens; identical to SEQ ID NO: 2561

SEQ ID NO: 2748 - DNA, 201 bp, Homo sapiens; identical to SEQ ID NO: 2562

SEQ ID NO: 2749 - DNA, 201 bp, Homo sapiens; identical to SEQ ID NO: 2563

SEQ ID NO: 2750 - DNA, 201 bp, Homo sapiens; identical to SEQ ID NO: 2564

SEQ ID NO: 2751 - DNA, 201 bp, Homo sapiens; identical to SEQ ID NO: 2565

SEQ ID NO: 2752 - DNA, 201 bp, Homo sapiens; identical to SEQ ID NO: 2566

SEQ ID NO: 2753 - DNA, 201 bp, Homo sapiens; identical to SEQ ID NO: 2567

SEQ ID NO: 2754 - DNA, 201 bp, Homo sapiens; identical to SEQ ID NO: 2568

SEQ ID NO: 2755 - DNA, 187 bp, Homo sapiens; identical to SEQ ID NO: 2569

SEQ ID NO: 2756 - DNA, 201 bp, Homo sapiens; identical to SEQ ID NO: 2570

SEQ ID NO: 2757 - DNA, 201 bp, Homo sapiens; identical to SEQ ID NO: 2571

SEQ ID NO: 2758 - DNA, 201 bp, Homo sapiens; identical to SEQ ID NO: 2572

SEQ ID NO: 2759 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggctggagtgctgtggcaccatcatggct

SEQ ID NO: 2760 - DNA, 201 bp, Homo sapiens
ggagtgctgtggcaccatcatggctcactgcagcctcaacctcctgggctcaagtgatcctcctgcctcagcctcccatgtagctagaactacagatacaygtaccaccatgtctggctaatttatttttctttttagagatgggttctcactatgttgcccaggccggtctcaaaaccctgggctcaagtgatcctcatg

SEQ ID NO: 2761 - DNA, 201 bp, Homo sapiens
tcccatgtagctagaactacagatacacgtaccaccatgtctggctaatttatttttctttttagagatgggttctcactatgttgcccaggccggtctcraaaccctgggctcaagtgatcctcatgcctcaacctcccaaagtgctaagattataggcatgaccaccatgcctggccttttctgctttctgaggaggaa

SEQ ID NO: 2762 - DNA, 201 bp, Homo sapiens
ctgagaacaacaggacaagctggggcacaaatgcaaagatgcagagggaggcaacacctggtcatctgtgagaccttcatgggacctgaagacgcagcacwgaggaggaacttgaaaaaggacgggatttctactactcaagcatgtaggagctcaggatattcttccagcctagggtgaatgtttccccctccaagaagg

SEQ ID NO: 2763 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggctggagtgctgtggcaccatcatggctcactgcagcctcaacctcctg

SEQ ID NO: 2764 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggctggagtgctgtggcaccatcatggctcactgcagcctcaacctcctggg

SEQ ID NO: 2765 - DNA, 153 bp, Homo sapiens; identical to SEQ ID NO: 2483

SEQ ID NO: 2766 - DNA, 201 bp, Homo sapiens; identical to SEQ ID NO: 2484

SEQ ID NO: 2767 - DNA, 201 bp, Homo sapiens; identical to SEQ ID NO: 2485

SEQ ID NO: 2768 - DNA, 201 bp, Homo sapiens; identical to SEQ ID NO: 2486

SEQ ID NO: 2769 - DNA, 201 bp, Homo sapiens
caaccgggaggagttcgcgcgcttcgacagcgacgtgggggagttccgggcggtgacggagctggggcggcctgctgcggagtactggaacagccagaagsacatcctggaggagaagcgggcagtgccggacaggatgtgcagacacaactacgagctgggcgggcccatgaccctgcagcgccgaggctggagtgctgt

SEQ ID NO: 2770 - DNA, 201 bp, Homo sapiens
cgggaggagttcgcgcgcttcgacagcgacgtgggggagttccgggcggtgacggagctggggcggcctgctgcggagtactggaacagccagaaggacawcctggaggagaagcgggcagtgccggacaggatgtgcagacacaactacgagctgggcgggcccatgaccctgcagcgccgaggctggagtgctgtggca

SEQ ID NO: 2771 - DNA, 201 bp, Homo sapiens
ggagttcgcgcgcttcgacagcgacgtgggggagttccgggcggtgacggagctggggcggcctgctgcggagtactggaacagccagaaggacatcctgkaggagaagcgggcagtgccggacaggatgtgcagacacaactacgagctgggcgggcccatgaccctgcagcgccgaggctggagtgctgtggcaccatc

SEQ ID NO: 2772 - DNA, 201 bp, Homo sapiens
gcgcttcgacagcgacgtgggggagttccgggcggtgacggagctggggcggcctgctgcggagtactggaacagccagaaggacatcctggaggagaagygggcagtgccggacaggatgtgcagacacaactacgagctgggcgggcccatgaccctgcagcgccgaggctggagtgctgtggcaccatcatggctcac

SEQ ID NO: 2773 - DNA, 201 bp, Homo sapiens
gcttcgacagcgacgtgggggagttccgggcggtgacggagctggggcggcctgctgcggagtactggaacagccagaaggacatcctggaggagaagcgkgcagtgccggacaggatgtgcagacacaactacgagctgggcgggcccatgaccctgcagcgccgaggctggagtgctgtggcaccatcatggctcactg

SEQ ID NO: 2774 - DNA, 201 bp, Homo sapiens; identical to SEQ ID NO: 2493

SEQ ID NO: 2775 - DNA, 201 bp, Homo sapiens
cgacagcgacgtgggggagttccgggcggtgacggagctggggcggcctgctgcggagtactggaacagccagaaggacatcctggaggagaagcgggcaktgccggacaggatgtgcagacacaactacgagctgggcgggcccatgaccctgcagcgccgaggctggagtgctgtggcaccatcatggctcactgcagc

SEQ ID NO: 2776 - DNA, 201 bp, Homo sapiens
acagcgacgtgggggagttccgggcggtgacggagctggggcggcctgctgcggagtactggaacagccagaaggacatcctggaggagaagcgggcagtkccggacaggatgtgcagacacaactacgagctgggcgggcccatgaccctgcagcgccgaggctggagtgctgtggcaccatcatggctcactgcagcct

SEQ ID NO: 2777 - DNA, 201 bp, Homo sapiens
agcgacgtgggggagttccgggcggtgacggagctggggcggcctgctgcggagtactggaacagccagaaggacatcctggaggagaagcgggcagtgcyggacaggatgtgcagacacaactacgagctgggcgggcccatgaccctgcagcgccgaggctggagtgctgtggcaccatcatggctcactgcagcctca

SEQ ID NO: 2778 - DNA, 201 bp, Homo sapiens; identical to SEQ ID NO: 2496

SEQ ID NO: 2779 - DNA, 201 bp, Homo sapiens
tgggggagttccgggcggtgacggagctggggcggcctgctgcggagtactggaacagccagaaggacatcctggaggagaagcgggcagtgccggacagratgtgcagacacaactacgagctgggcgggcccatgaccctgcagcgccgaggctggagtgctgtggcaccatcatggctcactgcagcctcaacctcct

SEQ ID NO: 2780 - DNA, 201 bp, Homo sapiens
cggagtactggaacagccagaaggacatcctggaggagaagcgggcagtgccggacaggatgtgcagacacaactacgagctgggcgggcccatgaccctrcagcgccgaggctggagtgctgtggcaccatcatggctcactgcagcctcaacctcctgggctcaagtgatcctcctgcctcagcctcccatgtagctag

SEQ ID NO: 2781 - DNA, 201 bp, Homo sapiens
ggcatgaccaccatgcctggccttttctgctttctgaggaggaaaaaggtactggtggcagagatccaaaagaaaagttgccagtggcagtgtggaaattsacctgagaacaacaggacaagctggggcacaaatgcaaagatgcagagggaggcaacacctggtcatctgtgagaccttcatgggacctgaagacgcagc

SEQ ID NO: 2782 - DNA, 201 bp, Homo sapiens
atctgtgagaccttcatgggacctgaagacgcagcacagaggaggaacttgaaaaaggacgggatttctactactcaagcatgtaggagctcaggatattmttccagcctagggtgaatgtttccccctccaagaaggggcccttgcagcaccacaacctgcttgtctgccacgtgacggatttctacccaggcagcattc

SEQ ID NO: 2783 - DNA, 201 bp, Homo sapiens; identical to SEQ ID NO: 2499

SEQ ID NO: 2784 - DNA, 201 bp, Homo sapiens
gcatgtaggagctcaggatattcttccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 2785 - DNA, 201 bp, Homo sapiens
ctcagcctcccatgtagctagaactacagatacacgtaccaccatgtctggctaatttatttttctttttagagatgggttctcactatgttgcccaggcyggtctcaaaaccctgggctcaagtgatcctcatgcctcaacctcccaaagtgctaagattataggcatgaccaccatgcctggccttttctgctttctga

SEQ ID NO: 2786 - DNA, 201 bp, Homo sapiens; identical to SEQ ID NO: 2501

SEQ ID NO: 2787 - DNA, 201 bp, Homo sapiens; identical to SEQ ID NO: 2502

SEQ ID NO: 2788 - DNA, 201 bp, Homo sapiens; identical to SEQ ID NO: 2503

SEQ ID NO: 2789 - DNA, 201 bp, Homo sapiens; identical to SEQ ID NO: 2504

SEQ ID NO: 2790 - DNA, 201 bp, Homo sapiens; identical to SEQ ID NO: 2505

SEQ ID NO: 2791 - DNA, 201 bp, Homo sapiens
ccaggccggtctcaaaaccctgggctcaagtgatcctcatgcctcaacctcccaaagtgctaagattataggcatgaccaccatgcctggccttttctgcyttctgaggaggaaaaaggtactggtggcagagatccaaaagaaaagttgccagtggcagtgtggaaattcacctgagaacaacaggacaagctggggcac

SEQ ID NO: 2792 - DNA, 201 bp, Homo sapiens; identical to SEQ ID NO: 2506

SEQ ID NO: 2793 - DNA, 201 bp, Homo sapiens
acaagctggggcacaaatgcaaagatgcagagggaggcaacacctggtcatctgtgagaccttcatgggacctgaagacgcagcacagaggaggaacttgraaaaggacgggatttctactactcaagcatgtaggagctcaggatattcttccagcctagggtgaatgtttccccctccaagaaggggcccttgcagcac

SEQ ID NO: 2794 - DNA, 201 bp, Homo sapiens; identical to SEQ ID NO: 2507

SEQ ID NO: 2795 - DNA, 201 bp, Homo sapiens
tcacctgagaacaacaggacaagctggggcacaaatgcaaagatgcagagggaggcaacacctggtcatctgtgagaccttcatgggacctgaagacgcakcacagaggaggaacttgaaaaaggacgggatttctactactcaagcatgtaggagctcaggatattcttccagcctagggtgaatgtttccccctccaag

SEQ ID NO: 2796 - DNA, 201 bp, Homo sapiens
ctggccttttctgctttctgaggaggaaaaaggtactggtggcagagatccaaaagaaaagttgccagtggcagtgtggaaattcacctgagaacaacagracaagctggggcacaaatgcaaagatgcagagggaggcaacacctggtcatctgtgagaccttcatgggacctgaagacgcagcacagaggaggaacttg

SEQ ID NO: 2797 - DNA, 201 bp, Homo sapiens
gggcacaaatgcaaagatgcagagggaggcaacacctggtcatctgtgagaccttcatgggacctgaagacgcagcacagaggaggaacttgaaaaaggaygggatttctactactcaagcatgtaggagctcaggatattcttccagcctagggtgaatgtttccccctccaagaaggggcccttgcagcaccacaacct

SEQ ID NO: 2798 - DNA, 201 bp, Homo sapiens
gcaacacctggtcatctgtgagaccttcatgggacctgaagacgcagcacagaggaggaacttgaaaaaggacgggatttctactactcaagcatgtaggrgctcaggatattcttccagcctagggtgaatgtttccccctccaagaaggggcccttgcagcaccacaacctgcttgtctgccacgtgacggatttctac

SEQ ID NO: 2799 - DNA, 201 bp, Homo sapiens
ccaaaagaaaagttgccagtggcagtgtggaaattcacctgagaacaacaggacaagctggggcacaaatgcaaagatgcagagggaggcaacacctggtyatctgtgagaccttcatgggacctgaagacgcagcacagaggaggaacttgaaaaaggacgggatttctactactcaagcatgtaggagctcaggatatt

SEQ ID NO: 2800 - DNA, 201 bp, Homo sapiens
ggacctgaagacgcagcacagaggaggaacttgaaaaaggacgggatttctactactcaagcatgtaggagctcaggatattcttccagcctagggtgaaygtttccccctccaagaaggggcccttgcagcaccacaacctgcttgtctgccacgtgacggatttctacccaggcagcattcaagtccgatggttcctga

SEQ ID NO: 2801 - DNA, 201 bp, Homo sapiens; identical to SEQ ID NO: 2509

SEQ ID NO: 2802 - DNA, 201 bp, Homo sapiens; identical to SEQ ID NO: 2511

SEQ ID NO: 2803 - DNA, 201 bp, Homo sapiens; identical to SEQ ID NO: 2510

SEQ ID NO: 2804 - DNA, 201 bp, Homo sapiens
tactggaacagccagaaggacatcctggaggagaagcgggcagtgccggacaggatgtgcagacacaactacgagctgggcgggcccatgaccctgcagcrccgaggctggagtgctgtggcaccatcatggctcactgcagcctcaacctcctgggctcaagtgatcctcctgcctcagcctcccatgtagctagaacta

SEQ ID NO: 2805 - DNA, 148 bp, Homo sapiens; identical to SEQ ID NO: 2513

SEQ ID NO: 2806 - DNA, 201 bp, Homo sapiens
actggaacagccagaaggacatcctggaggagaagcgggcagtgccggacaggatgtgcagacacaactacgagctgggcgggcccatgaccctgcagcgycgaggctggagtgctgtggcaccatcatggctcactgcagcctcaacctcctgggctcaagtgatcctcctgcctcagcctcccatgtagctagaactac

SEQ ID NO: 2807 - DNA, 201 bp, Homo sapiens
agaagcgggcagtgccggacaggatgtgcagacacaactacgagctgggcgggcccatgaccctgcagcgccgaggctggagtgctgtggcaccatcatgrctcactgcagcctcaacctcctgggctcaagtgatcctcctgcctcagcctcccatgtagctagaactacagatacacgtaccaccatgtctggctaatt

SEQ ID NO: 2808 - DNA, 201 bp, Homo sapiens
ggaacttgaaaaaggacgggatttctactactcaagcatgtaggagctcaggatattcttccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 2809 - DNA, 201 bp, Homo sapiens; identical to SEQ ID NO: 2516

SEQ ID NO: 2810 - DNA, 201 bp, Homo sapiens; identical to SEQ ID NO: 2517

SEQ ID NO: 2811 - DNA, 201 bp, Homo sapiens
tcctggaggagaagcgggcagtgccggacaggatgtgcagacacaactacgagctgggcgggcccatgaccctgcagcgccgaggctggagtgctgtggcrccatcatggctcactgcagcctcaacctcctgggctcaagtgatcctcctgcctcagcctcccatgtagctagaactacagatacacgtaccaccatgtc

SEQ ID NO: 2812 - DNA, 201 bp, Homo sapiens; identical to SEQ ID NO: 2518

SEQ ID NO: 2813 - DNA, 201 bp, Homo sapiens; identical to SEQ ID NO: 2519

SEQ ID NO: 2814 - DNA, 201 bp, Homo sapiens; identical to SEQ ID NO: 2520

SEQ ID NO: 2815 - DNA, 201 bp, Homo sapiens; identical to SEQ ID NO: 2521

SEQ ID NO: 2816 - DNA, 201 bp, Homo sapiens
accatgtctggctaatttatttttctttttagagatgggttctcactatgttgcccaggccggtctcaaaaccctgggctcaagtgatcctcatgcctcarcctcccaaagtgctaagattataggcatgaccaccatgcctggccttttctgctttctgaggaggaaaaaggtactggtggcagagatccaaaagaaaag

SEQ ID NO: 2817 - DNA, 201 bp, Homo sapiens
gtctcaaaaccctgggctcaagtgatcctcatgcctcaacctcccaaagtgctaagattataggcatgaccaccatgcctggccttttctgctttctgagraggaaaaaggtactggtggcagagatccaaaagaaaagttgccagtggcagtgtggaaattcacctgagaacaacaggacaagctggggcacaaatgcaa

SEQ ID NO: 2818 - DNA, 201 bp, Homo sapiens; identical to SEQ ID NO: 2522

SEQ ID NO: 2819 - DNA, 201 bp, Homo sapiens; identical to SEQ ID NO: 2523

SEQ ID NO: 2820 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggctggagtgctgtggcaccatcatggctcactgcagcctcaacctcctgggctcaagtgatcctcctgcctcag

SEQ ID NO: 2821 - DNA, 201 bp, Homo sapiens; identical to SEQ ID NO: 2525

SEQ ID NO: 2822 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggctggagtgctgtggcaccatcatggctc

SEQ ID NO: 2823 - DNA, 201 bp, Homo sapiens; identical to SEQ ID NO: 2527

SEQ ID NO: 2824 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggctggagtgctgtggcaccatcatggctcactgcagcctcaacctcctgggctcaagtgatcctcctgcctcagcct

SEQ ID NO: 2825 - DNA, 201 bp, Homo sapiens
agagatccaaaagaaaagttgccagtggcagtgtggaaattcacctgagaacaacaggacaagctggggcacaaatgcaaagatgcagagggaggcaacayctggtcatctgtgagaccttcatgggacctgaagacgcagcacagaggaggaacttgaaaaaggacgggatttctactactcaagcatgtaggagctcag

SEQ ID NO: 2826 - DNA, 201 bp, Homo sapiens; identical to SEQ ID NO: 2529

SEQ ID NO: 2827 - DNA, 201 bp, Homo sapiens; identical to SEQ ID NO: 2531

SEQ ID NO: 2828 - DNA, 201 bp, Homo sapiens; identical to SEQ ID NO: 2530

SEQ ID NO: 2829 - DNA, 201 bp, Homo sapiens; identical to SEQ ID NO: 2533

SEQ ID NO: 2830 - DNA, 201 bp, Homo sapiens; identical to SEQ ID NO: 2532

SEQ ID NO: 2831 - DNA, 201 bp, Homo sapiens; identical to SEQ ID NO: 2535

SEQ ID NO: 2832 - DNA, 201 bp, Homo sapiens; identical to SEQ ID NO: 2534

SEQ ID NO: 2833 - DNA, 201 bp, Homo sapiens; identical to SEQ ID NO: 2536

SEQ ID NO: 2834 - DNA, 201 bp, Homo sapiens; identical to SEQ ID NO: 2537

SEQ ID NO: 2835 - DNA, 201 bp, Homo sapiens; identical to SEQ ID NO: 2538

SEQ ID NO: 2836 - DNA, 201 bp, Homo sapiens; identical to SEQ ID NO: 2539

SEQ ID NO: 2837 - DNA, 201 bp, Homo sapiens; identical to SEQ ID NO: 2540

SEQ ID NO: 2838 - DNA, 201 bp, Homo sapiens; identical to SEQ ID NO: 2541

SEQ ID NO: 2839 - DNA, 201 bp, Homo sapiens; identical to SEQ ID NO: 2542

SEQ ID NO: 2840 - DNA, 201 bp, Homo sapiens; identical to SEQ ID NO: 2544

SEQ ID NO: 2841 - DNA, 201 bp, Homo sapiens; identical to SEQ ID NO: 2543

SEQ ID NO: 2842 - DNA, 201 bp, Homo sapiens; identical to SEQ ID NO: 2545

SEQ ID NO: 2843 - DNA, 201 bp, Homo sapiens; identical to SEQ ID NO: 2546

SEQ ID NO: 2844 - DNA, 201 bp, Homo sapiens; identical to SEQ ID NO: 2547

SEQ ID NO: 2845 - DNA, 201 bp, Homo sapiens; identical to SEQ ID NO: 2548

SEQ ID NO: 2846 - DNA, 201 bp, Homo sapiens
acgtaccaccatgtctggctaatttatttttctttttagagatgggttctcactatgttgcccaggccggtctcaaaaccctgggctcaagtgatcctcaygcctcaacctcccaaagtgctaagattataggcatgaccaccatgcctggccttttctgctttctgaggaggaaaaaggtactggtggcagagatccaaa

SEQ ID NO: 2847 - DNA, 201 bp, Homo sapiens; identical to SEQ ID NO: 2549

SEQ ID NO: 2848 - DNA, 201 bp, Homo sapiens; identical to SEQ ID NO: 2550

SEQ ID NO: 2849 - DNA, 201 bp, Homo sapiens
ccgggaggagttcgcgcgcttcgacagcgacgtgggggagttccgggcggtgacggagctggggcggcctgctgcggagtactggaacagccagaaggachtcctggaggagaagcgggcagtgccggacaggatgtgcagacacaactacgagctgggcgggcccatgaccctgcagcgccgaggctggagtgctgtggc

SEQ ID NO: 2850 - DNA, 201 bp, Homo sapiens
aattcacctgagaacaacaggacaagctggggcacaaatgcaaagatgcagagggaggcaacacctggtcatctgtgagaccttcatgggacctgaagacrcagcacagaggaggaacttgaaaaaggacgggatttctactactcaagcatgtaggagctcaggatattcttccagcctagggtgaatgtttccccctcc

SEQ ID NO: 2851 - DNA, 201 bp, Homo sapiens
tgagaacaacaggacaagctggggcacaaatgcaaagatgcagagggaggcaacacctggtcatctgtgagaccttcatgggacctgaagacgcagcacakaggaggaacttgaaaaaggacgggatttctactactcaagcatgtaggagctcaggatattcttccagcctagggtgaatgtttccccctccaagaaggg

SEQ ID NO: 2852 - DNA, 201 bp, Homo sapiens
cttcatgggacctgaagacgcagcacagaggaggaacttgaaaaaggacgggatttctactactcaagcatgtaggagctcaggatattcttccagcctarggtgaatgtttccccctccaagaaggggcccttgcagcaccacaacctgcttgtctgccacgtgacggatttctacccaggcagcattcaagtccgatgg

SEQ ID NO: 2853 - DNA, 201 bp, Homo sapiens; identical to SEQ ID NO: 2553

SEQ ID NO: 2854 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggctggagtgctgtggcaccatcatggctcactgcagcctcaacctcctgggctcaagtgatcctcctgcctcagcctccca

SEQ ID NO: 2855 - DNA, 201 bp, Homo sapiens
aggatattcttccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 2856 - DNA, 201 bp, Homo sapiens; identical to SEQ ID NO: 2556

SEQ ID NO: 2857 - DNA, 201 bp, Homo sapiens
tactactcaagcatgtaggagctcaggatattcttccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 2858 - DNA, 201 bp, Homo sapiens; identical to SEQ ID NO: 2558

SEQ ID NO: 2859 - DNA, 201 bp, Homo sapiens
gaggaggaacttgaaaaaggacgggatttctactactcaagcatgtaggagctcaggatattcttccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 2860 - DNA, 201 bp, Homo sapiens; identical to SEQ ID NO: 2560

SEQ ID NO: 2861 - DNA, 201 bp, Homo sapiens; identical to SEQ ID NO: 2561

SEQ ID NO: 2862 - DNA, 201 bp, Homo sapiens; identical to SEQ ID NO: 2562

SEQ ID NO: 2863 - DNA, 201 bp, Homo sapiens; identical to SEQ ID NO: 2563

SEQ ID NO: 2864 - DNA, 201 bp, Homo sapiens; identical to SEQ ID NO: 2564

SEQ ID NO: 2865 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggctggagtgctgtggcaccatcatggctcactgcagcctcaacctcctgggctcaagtgatcctcctgcctcagcctcc

SEQ ID NO: 2866 - DNA, 201 bp, Homo sapiens; identical to SEQ ID NO: 2565

SEQ ID NO: 2867 - DNA, 201 bp, Homo sapiens; identical to SEQ ID NO: 2568

SEQ ID NO: 2868 - DNA, 201 bp, Homo sapiens; identical to SEQ ID NO: 2567

SEQ ID NO: 2869 - DNA, 187 bp, Homo sapiens; identical to SEQ ID NO: 2569

SEQ ID NO: 2870 - DNA, 201 bp, Homo sapiens; identical to SEQ ID NO: 2571

SEQ ID NO: 2871 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggctggagtgctgtggcaccatcatggctcactgcagcctcaacctcctgggctcaagtgatcctcctgcctcagcctcccat

SEQ ID NO: 2872 - DNA, 201 bp, Homo sapiens; identical to SEQ ID NO: 2572

SEQ ID NO: 2873 - DNA, 201 bp, Homo sapiens
gccggtctcaaaaccctgggctcaagtgatcctcatgcctcaacctcccaaagtgctaagattataggcatgaccaccatgcctggccttttctgctttcygaggaggaaaaaggtactggtggcagagatccaaaagaaaagttgccagtggcagtgtggaaattcacctgagaacaacaggacaagctggggcacaaat

SEQ ID NO: 2874 - DNA, 134 bp, Homo sapiens
taggcgcgtgccgcgagaacagagtggacggagmgtaggagagaccgaaaaggctgggggtgggagtagcggatttgaagcacttgttggcctacagaggtgtggcaagcagagcacctcagaactcaggcgta

SEQ ID NO: 2875 - DNA, 201 bp, Homo sapiens
acctcgatctccttctccctcattttctctcatccctacctattgtgggtttccgcatgggccggaccgtggtcgtgctgggcggaggcatcagcggcttsgccgccagttaccacctgagccgggccccctgcccccctaaggtggtcctagtggagagcagtgagcgtctgggaggctggattcgctccgttcgaggcc

SEQ ID NO: 2876 - DNA, 201 bp, Homo sapiens
gtggtgaatctgcagtaccaaggagcccatctgcctgtccagggatttggacatttggtgccatcttcagaagatccaggagtcctgggaatcgtgtatgmctcagttgctttccctgagcaggacgggagcccccctggcctcagagtgactgtgatgctgggaggttcctggttacagacactggaggctagtggctgt

SEQ ID NO: 2877 - DNA, 201 bp, Homo sapiens
acacaagaactgcattccccagtatacactaggtcactggcaaaaactagagtcagctaggcaattcctgactgctcacaggttgcccctgactctggctrgagcctcctatgagggagttgctgttaatgactgtatagagagtgggcgccaggcagcagtcagtgtcctgggcacagaacctaacagctgatccccaac

SEQ ID NO: 2878 - DNA, 201 bp, Homo sapiens
ctgcccccctaaggtggtcctagtggagagcagtgagcgtctgggaggctggattcgctccgttcgaggccctaatggtgctatctttgagcttggacctyggggaattaggccagcgggagccctaggggcccggaccttgctcctggtttctgagcttggcttggattcagaagtgctgcctgtccggggagaccaccc

SEQ ID NO: 2879 - DNA, 201 bp, Homo sapiens
ggaggctggattcgctccgttcgaggccctaatggtgctatctttgagcttggacctcggggaattaggccagcgggagccctaggggcccggaccttgcycctggtttctgagcttggcttggattcagaagtgctgcctgtccggggagaccacccagctgcccagaacaggttcctctacgtgggcggtgccctgcat

SEQ ID NO: 2880 - DNA, 201 bp, Homo sapiens
tctctaagggacagcagtctggaggctgaccacgttattagtgccattccagcttcagtgctcagtgagctgctccctgctgaggctgcccctctggctcrtgccctgagtgccatcactgcagtgtctgtagctgtggtgaatctgcagtaccaaggagcccatctgcctgtccagggatttggacatttggtgccatct

SEQ ID NO: 2881 - DNA, 201 bp, Homo sapiens
ttatctgcacccagcagagcgccggcggggtacggtcttaggacctcgatctccttctccctcattttctctcatccctacctattgtgggtttccgcatvggccggaccgtggtcgtgctgggcggaggcatcagcggcttggccgccagttaccacctgagccgggccccctgcccccctaaggtggtcctagtggaga

SEQ ID NO: 2882 - DNA, 201 bp, Homo sapiens
cttatctgcacccagcagagcgccggcggggtacggtcttaggacctcgatctccttctccctcattttctctcatccctacctattgtgggtttccgcaygggccggaccgtggtcgtgctgggcggaggcatcagcggcttggccgccagttaccacctgagccgggccccctgcccccctaaggtggtcctagtggag

SEQ ID NO: 2883 - DNA, 201 bp, Homo sapiens
cggtcttaggacctcgatctccttctccctcattttctctcatccctacctattgtgggtttccgcatgggccggaccgtggtcgtgctgggcggaggcaycagcggcttggccgccagttaccacctgagccgggccccctgcccccctaaggtggtcctagtggagagcagtgagcgtctgggaggctggattcgctcc

SEQ ID NO: 2884 - DNA, 201 bp, Homo sapiens
tgctgggaggttcctggttacagacactggaggctagtggctgtgtcttatctcaggagctgtttcaacagcgggcccaggaagcagctgctacacaattmggactgaaggagatgccgagccactgcttggtccatctacacaagaactgcattccccagtatacactaggtcactggcaaaaactagagtcagctaggc

SEQ ID NO: 2885 - DNA, 201 bp, Homo sapiens
ggtggcgtctctagccatggacagtctctgccgtggagtgtttgcaggcaacagccgtgagctcagcatcaggtcctgctttcccagtctcttccaagctkagcaaacccatcgttccatattactgggcctgctgctgggggcagggcggaccccacagccagactcagcactcattcgccaggccttggctgagcgctg

SEQ ID NO: 2886 - DNA, 201 bp, Homo sapiens
ctcctggtttctgagcttggcttggattcagaagtgctgcctgtccggggagaccacccagctgcccagaacaggttcctctacgtgggcggtgccctgcmtgccctacccactggcctcagggggctactccgcccttcaccccccttctccaaacctctgttttgggctgggctgagggagctgaccaagccccggggc

SEQ ID NO: 2887 - DNA, 201 bp, Homo sapiens
ctacgtgggcggtgccctgcatgccctacccactggcctcagggggctactccgcccttcaccccccttctccaaacctctgttttgggctgggctgaggkagctgaccaagccccggggcaaagagcctgatgagactgtgcacagttttgcccagcgccgccttggacctgagtcctagtctcacccttaaggtggcgt

SEQ ID NO: 2888 - DNA, 201 bp, Homo sapiens
cccttctccaaacctctgttttgggctgggctgagggagctgaccaagccccggggcaaagagcctgatgagactgtgcacagttttgcccagcgccgccytggacctgagtcctagtctcacccttaaggtggcgtctctagccatggacagtctctgccgtggagtgtttgcaggcaacagccgtgagctcagcatcag

SEQ ID NO: 2889 - DNA, 201 bp, Homo sapiens
gcaggcaacagccgtgagctcagcatcaggtcctgctttcccagtctcttccaagctgagcaaacccatcgttccatattactgggcctgctgctgggggyagggcggaccccacagccagactcagcactcattcgccaggccttggctgagcgctggagccagtggtcacttcgtggaggtctagagatgttgcctcag

SEQ ID NO: 2890 - DNA, 201 bp, Homo sapiens
gctgtggtgaatctgcagtaccaaggagcccatctgcctgtccagggatttggacatttggtgccatcttcagaagatccaggagtcctgggaatcgtgtrtgactcagttgctttccctgagcaggacgggagcccccctggcctcagagtgactgtgatgctgggaggttcctggttacagacactggaggctagtggc

SEQ ID NO: 2891 - DNA, 201 bp, Homo sapiens
gttctcagaggccagccggtctgtgggctcagcctccaggcagaagggcgctggaaggtatctctaagggacagcagtctggaggctgaccacgttattaktgccattccagcttcagtgctcagtgagctgctccctgctgaggctgcccctctggctcgtgccctgagtgccatcactgcagtgtctgtagctgtggtg

SEQ ID NO: 2892 - DNA, 201 bp, Homo sapiens
agtgttctcagaggccagccggtctgtgggctcagcctccaggcagaagggcgctggaaggtatctctaagggacagcagtctggaggctgaccacgttawtagtgccattccagcttcagtgctcagtgagctgctccctgctgaggctgcccctctggctcgtgccctgagtgccatcactgcagtgtctgtagctgtg

SEQ ID NO: 2893 - DNA, 201 bp, Homo sapiens
cccttcaccccccttctccaaacctctgttttgggctgggctgagggagctgaccaagccccggggcaaagagcctgatgagactgtgcacagttttgccyagcgccgccttggacctgagtcctagtctcacccttaaggtggcgtctctagccatggacagtctctgccgtggagtgtttgcaggcaacagccgtgagc

SEQ ID NO: 2894 - DNA, 201 bp, Homo sapiens
agaacaggttcctctacgtgggcggtgccctgcatgccctacccactggcctcagggggctactccgcccttcaccccccttctccaaacctctgttttgrgctgggctgagggagctgaccaagccccggggcaaagagcctgatgagactgtgcacagttttgcccagcgccgccttggacctgagtcctagtctcacc

SEQ ID NO: 2895 - DNA, 201 bp, Homo sapiens
actggcctcagggggctactccgcccttcaccccccttctccaaacctctgttttgggctgggctgagggagctgaccaagccccggggcaaagagcctgwtgagactgtgcacagttttgcccagcgccgccttggacctgagtcctagtctcacccttaaggtggcgtctctagccatggacagtctctgccgtggagt

SEQ ID NO: 2896 - DNA, 201 bp, Homo sapiens
ctgcatgccctacccactggcctcagggggctactccgcccttcaccccccttctccaaacctctgttttgggctgggctgagggagctgaccaagccccsgggcaaagagcctgatgagactgtgcacagttttgcccagcgccgccttggacctgagtcctagtctcacccttaaggtggcgtctctagccatggacag

SEQ ID NO: 2897 - DNA, 201 bp, Homo sapiens
cctgctgctgggggcagggcggaccccacagccagactcagcactcattcgccaggccttggctgagcgctggagccagtggtcacttcgtggaggtctaragatgttgcctcaggcccttgaaacccacctgactagtaggggggtcagtgttctcagaggccagccggtctgtgggctcagcctccaggcagaagggcg

SEQ ID NO: 2898 - DNA, 201 bp, Homo sapiens
ttcaccccccttctccaaacctctgttttgggctgggctgagggagctgaccaagccccggggcaaagagcctgatgagactgtgcacagttttgcccagygccgccttggacctgagtcctagtctcacccttaaggtggcgtctctagccatggacagtctctgccgtggagtgtttgcaggcaacagccgtgagctca

SEQ ID NO: 2899 - DNA, 201 bp, Homo sapiens
ggtgaatctgcagtaccaaggagcccatctgcctgtccagggatttggacatttggtgccatcttcagaagatccaggagtcctgggaatcgtgtatgacycagttgctttccctgagcaggacgggagcccccctggcctcagagtgactgtgatgctgggaggttcctggttacagacactggaggctagtggctgtgt

SEQ ID NO: 2900 - DNA, 201 bp, Homo sapiens
ctgagggagctgaccaagccccggggcaaagagcctgatgagactgtgcacagttttgcccagcgccgccttggacctgagtcctagtctcacccttaagvtggcgtctctagccatggacagtctctgccgtggagtgtttgcaggcaacagccgtgagctcagcatcaggtcctgctttcccagtctcttccaagctga

SEQ ID NO: 2901 - DNA, 201 bp, Homo sapiens
tgctgaggctgcccctctggctcgtgccctgagtgccatcactgcagtgtctgtagctgtggtgaatctgcagtaccaaggagcccatctgcctgtccagsgatttggacatttggtgccatcttcagaagatccaggagtcctgggaatcgtgtatgactcagttgctttccctgagcaggacgggagcccccctggcct

SEQ ID NO: 2902 - DNA, 201 bp, Homo sapiens
cgctggagccagtggtcacttcgtggaggtctagagatgttgcctcaggcccttgaaacccacctgactagtaggggggtcagtgttctcagaggccagcsggtctgtgggctcagcctccaggcagaagggcgctggaaggtatctctaagggacagcagtctggaggctgaccacgttattagtgccattccagcttca

SEQ ID NO: 2903 - DNA, 201 bp, Homo sapiens
gctgggggtgggagtagcggatttgaagcacttgttggcctacagaggtgtggcaagcagagcacctcagaactcaggcgtactgcccgccgcccgagccstgcgagggccgatagcgagggtgtggcccttatctgcacccagcagagcgccggcggggtacggtcttaggacctcgatctccttctccctcattttctc

SEQ ID NO: 2904 - DNA, 201 bp, Homo sapiens
cagcgccgccttggacctgagtcctagtctcacccttaaggtggcgtctctagccatggacagtctctgccgtggagtgtttgcaggcaacagccgtgagstcagcatcaggtcctgctttcccagtctcttccaagctgagcaaacccatcgttccatattactgggcctgctgctgggggcagggcggaccccacagcc

SEQ ID NO: 2905 - DNA, 201 bp, Homo sapiens
atgttgcctcaggcccttgaaacccacctgactagtaggggggtcagtgttctcagaggccagccggtctgtgggctcagcctccaggcagaagggcgctrgaaggtatctctaagggacagcagtctggaggctgaccacgttattagtgccattccagcttcagtgctcagtgagctgctccctgctgaggctgcccct

SEQ ID NO: 2906 - DNA, 201 bp, Homo sapiens
ggtacggtcttaggacctcgatctccttctccctcattttctctcatccctacctattgtgggtttccgcatgggccggaccgtggtcgtgctgggcggargcatcagcggcttggccgccagttaccacctgagccgggccccctgcccccctaaggtggtcctagtggagagcagtgagcgtctgggaggctggattcg

SEQ ID NO: 2907 - DNA, 201 bp, Homo sapiens
ggtctgtgggctcagcctccaggcagaagggcgctggaaggtatctctaagggacagcagtctggaggctgaccacgttattagtgccattccagcttcartgctcagtgagctgctccctgctgaggctgcccctctggctcgtgccctgagtgccatcactgcagtgtctgtagctgtggtgaatctgcagtaccaagg

SEQ ID NO: 2908 - DNA, 201 bp, Homo sapiens
ctccaggcagaagggcgctggaaggtatctctaagggacagcagtctggaggctgaccacgttattagtgccattccagcttcagtgctcagtgagctgcyccctgctgaggctgcccctctggctcgtgccctgagtgccatcactgcagtgtctgtagctgtggtgaatctgcagtaccaaggagcccatctgcctgtc

SEQ ID NO: 2909 - DNA, 201 bp, Homo sapiens
ctggctcgtgccctgagtgccatcactgcagtgtctgtagctgtggtgaatctgcagtaccaaggagcccatctgcctgtccagggatttggacatttggkgccatcttcagaagatccaggagtcctgggaatcgtgtatgactcagttgctttccctgagcaggacgggagcccccctggcctcagagtgactgtgatg

SEQ ID NO: 2910 - DNA, 201 bp, Homo sapiens
atccaggagtcctgggaatcgtgtatgactcagttgctttccctgagcaggacgggagcccccctggcctcagagtgactgtgatgctgggaggttcctgrttacagacactggaggctagtggctgtgtcttatctcaggagctgtttcaacagcgggcccaggaagcagctgctacacaattaggactgaaggagatgc

SEQ ID NO: 2911 - DNA, 201 bp, Homo sapiens
aggagtcctgggaatcgtgtatgactcagttgctttccctgagcaggacgggagcccccctggcctcagagtgactgtgatgctgggaggttcctggttayagacactggaggctagtggctgtgtcttatctcaggagctgtttcaacagcgggcccaggaagcagctgctacacaattaggactgaaggagatgccgag

SEQ ID NO: 2912 - DNA, 201 bp, Homo sapiens
acaattaggactgaaggagatgccgagccactgcttggtccatctacacaagaactgcattccccagtatacactaggtcactggcaaaaactagagtcasctaggcaattcctgactgctcacaggttgcccctgactctggctggagcctcctatgagggagttgctgttaatgactgtatagagagtgggcgccaggc

SEQ ID NO: 2913 - DNA, 201 bp, Homo sapiens
aggactgaaggagatgccgagccactgcttggtccatctacacaagaactgcattccccagtatacactaggtcactggcaaaaactagagtcagctaggyaattcctgactgctcacaggttgcccctgactctggctggagcctcctatgagggagttgctgttaatgactgtatagagagtgggcgccaggcagcagt

SEQ ID NO: 2914 - DNA, 201 bp, Homo sapiens
actgggcctgctgctgggggcagggcggaccccacagccagactcagcactcattcgccaggccttggctgagcgctggagccagtggtcacttcgtggasgtctagagatgttgcctcaggcccttgaaacccacctgactagtaggggggtcagtgttctcagaggccagccggtctgtgggctcagcctccaggcaga

SEQ ID NO: 2915 - DNA, 201 bp, Homo sapiens
gaactgcattccccagtatacactaggtcactggcaaaaactagagtcagctaggcaattcctgactgctcacaggttgcccctgactctggctggagccycctatgagggagttgctgttaatgactgtatagagagtgggcgccaggcagcagtcagtgtcctgggcacagaacctaacagctgatccccaactctcat

SEQ ID NO: 2916 - DNA, 201 bp, Homo sapiens
ctgggggcagggcggaccccacagccagactcagcactcattcgccaggccttggctgagcgctggagccagtggtcacttcgtggaggtctagagatgtygcctcaggcccttgaaacccacctgactagtaggggggtcagtgttctcagaggccagccggtctgtgggctcagcctccaggcagaagggcgctggaag

SEQ ID NO: 2917 - DNA, 201 bp, Homo sapiens
ctgtgcacagttttgcccagcgccgccttggacctgagtcctagtctcacccttaaggtggcgtctctagccatggacagtctctgccgtggagtgtttgyaggcaacagccgtgagctcagcatcaggtcctgctttcccagtctcttccaagctgagcaaacccatcgttccatattactgggcctgctgctgggggca

SEQ ID NO: 2918 - DNA, 201 bp, Homo sapiens
ccttaaggtggcgtctctagccatggacagtctctgccgtggagtgtttgcaggcaacagccgtgagctcagcatcaggtcctgctttcccagtctcttcyaagctgagcaaacccatcgttccatattactgggcctgctgctgggggcagggcggaccccacagccagactcagcactcattcgccaggccttggctga

SEQ ID NO: 2919 - DNA, 201 bp, Homo sapiens
ccccagtatacactaggtcactggcaaaaactagagtcagctaggcaattcctgactgctcacaggttgcccctgactctggctggagcctcctatgaggkagttgctgttaatgactgtatagagagtgggcgccaggcagcagtcagtgtcctgggcacagaacctaacagctgatccccaactctcattcatgaaaat

SEQ ID NO: 2920 - DNA, 201 bp, Homo sapiens
tccccagtatacactaggtcactggcaaaaactagagtcagctaggcaattcctgactgctcacaggttgcccctgactctggctggagcctcctatgagrgagttgctgttaatgactgtatagagagtgggcgccaggcagcagtcagtgtcctgggcacagaacctaacagctgatccccaactctcattcatgaaaa

SEQ ID NO: 2921 - DNA, 201 bp, Homo sapiens
agtctctgccgtggagtgtttgcaggcaacagccgtgagctcagcatcaggtcctgctttcccagtctcttccaagctgagcaaacccatcgttccatatkactgggcctgctgctgggggcagggcggaccccacagccagactcagcactcattcgccaggccttggctgagcgctggagccagtggtcacttcgtgga

SEQ ID NO: 2922 - DNA, 201 bp, Homo sapiens
agcaaacccatcgttccatattactgggcctgctgctgggggcagggcggaccccacagccagactcagcactcattcgccaggccttggctgagcgctgragccagtggtcacttcgtggaggtctagagatgttgcctcaggcccttgaaacccacctgactagtaggggggtcagtgttctcagaggccagccggtct

SEQ ID NO: 2923 - DNA, 201 bp, Homo sapiens
tcgctgttccaccagcccatccgtgcacacttagtttcccctaaagcagtttccgcatgggccggaccgtggtcgtgctgggcggaggcatcagcggcttsgccgccagttaccacctgagccgggccccctgcccccctaaggtggtcctagtggagagcagtgagcgtctgggaggctggattcgctccgttcgaggcc

SEQ ID NO: 2924 - DNA, 201 bp, Homo sapiens; identical to SEQ ID NO: 2876

SEQ ID NO: 2925 - DNA, 201 bp, Homo sapiens; identical to SEQ ID NO: 2877

SEQ ID NO: 2926 - DNA, 201 bp, Homo sapiens; identical to SEQ ID NO: 2878

SEQ ID NO: 2927 - DNA, 201 bp, Homo sapiens; identical to SEQ ID NO: 2879

SEQ ID NO: 2928 - DNA, 201 bp, Homo sapiens; identical to SEQ ID NO: 2880

SEQ ID NO: 2929 - DNA, 181 bp, Homo sapiens
tcctggcccctggacggggacctcgctgttccaccagcccatccgtgcacacttagtttcccctaaagcagtttccgcatvggccggaccgtggtcgtgctgggcggaggcatcagcggcttggccgccagttaccacctgagccgggccccctgcccccctaaggtggtcctagtggaga

SEQ ID NO: 2930 - DNA, 180 bp, Homo sapiens
tcctggcccctggacggggacctcgctgttccaccagcccatccgtgcacacttagtttcccctaaagcagtttccgcaygggccggaccgtggtcgtgctgggcggaggcatcagcggcttggccgccagttaccacctgagccgggccccctgcccccctaaggtggtcctagtggag

SEQ ID NO: 2931 - DNA, 201 bp, Homo sapiens
gacggggacctcgctgttccaccagcccatccgtgcacacttagtttcccctaaagcagtttccgcatgggccggaccgtggtcgtgctgggcggaggcaycagcggcttggccgccagttaccacctgagccgggccccctgcccccctaaggtggtcctagtggagagcagtgagcgtctgggaggctggattcgctcc

SEQ ID NO: 2932 - DNA, 201 bp, Homo sapiens; identical to SEQ ID NO: 2884

SEQ ID NO: 2933 - DNA, 201 bp, Homo sapiens; identical to SEQ ID NO: 2885

SEQ ID NO: 2934 - DNA, 201 bp, Homo sapiens; identical to SEQ ID NO: 2886

SEQ ID NO: 2935 - DNA, 201 bp, Homo sapiens; identical to SEQ ID NO: 2887

SEQ ID NO: 2936 - DNA, 201 bp, Homo sapiens; identical to SEQ ID NO: 2888

SEQ ID NO: 2937 - DNA, 201 bp, Homo sapiens; identical to SEQ ID NO: 2889

SEQ ID NO: 2938 - DNA, 201 bp, Homo sapiens; identical to SEQ ID NO: 2890

SEQ ID NO: 2939 - DNA, 201 bp, Homo sapiens; identical to SEQ ID NO: 2891

SEQ ID NO: 2940 - DNA, 201 bp, Homo sapiens; identical to SEQ ID NO: 2892

SEQ ID NO: 2941 - DNA, 201 bp, Homo sapiens; identical to SEQ ID NO: 2893

SEQ ID NO: 2942 - DNA, 201 bp, Homo sapiens; identical to SEQ ID NO: 2894

SEQ ID NO: 2943 - DNA, 201 bp, Homo sapiens; identical to SEQ ID NO: 2895

SEQ ID NO: 2944 - DNA, 201 bp, Homo sapiens; identical to SEQ ID NO: 2896

SEQ ID NO: 2945 - DNA, 201 bp, Homo sapiens; identical to SEQ ID NO: 2897

SEQ ID NO: 2946 - DNA, 201 bp, Homo sapiens; identical to SEQ ID NO: 2899

SEQ ID NO: 2947 - DNA, 201 bp, Homo sapiens; identical to SEQ ID NO: 2898

SEQ ID NO: 2948 - DNA, 201 bp, Homo sapiens; identical to SEQ ID NO: 2900

SEQ ID NO: 2949 - DNA, 201 bp, Homo sapiens; identical to SEQ ID NO: 2901

SEQ ID NO: 2950 - DNA, 201 bp, Homo sapiens; identical to SEQ ID NO: 2902

SEQ ID NO: 2951 - DNA, 201 bp, Homo sapiens; identical to SEQ ID NO: 2904

SEQ ID NO: 2952 - DNA, 201 bp, Homo sapiens; identical to SEQ ID NO: 2905

SEQ ID NO: 2953 - DNA, 201 bp, Homo sapiens
cctggacggggacctcgctgttccaccagcccatccgtgcacacttagtttcccctaaagcagtttccgcatgggccggaccgtggtcgtgctgggcggargcatcagcggcttggccgccagttaccacctgagccgggccccctgcccccctaaggtggtcctagtggagagcagtgagcgtctgggaggctggattcg

SEQ ID NO: 2954 - DNA, 201 bp, Homo sapiens; identical to SEQ ID NO: 2907

SEQ ID NO: 2955 - DNA, 201 bp, Homo sapiens; identical to SEQ ID NO: 2908

SEQ ID NO: 2956 - DNA, 201 bp, Homo sapiens; identical to SEQ ID NO: 2909

SEQ ID NO: 2957 - DNA, 201 bp, Homo sapiens; identical to SEQ ID NO: 2910

SEQ ID NO: 2958 - DNA, 201 bp, Homo sapiens; identical to SEQ ID NO: 2911

SEQ ID NO: 2959 - DNA, 201 bp, Homo sapiens; identical to SEQ ID NO: 2912

SEQ ID NO: 2960 - DNA, 201 bp, Homo sapiens; identical to SEQ ID NO: 2913

SEQ ID NO: 2961 - DNA, 201 bp, Homo sapiens; identical to SEQ ID NO: 2914

SEQ ID NO: 2962 - DNA, 201 bp, Homo sapiens; identical to SEQ ID NO: 2915

SEQ ID NO: 2963 - DNA, 201 bp, Homo sapiens; identical to SEQ ID NO: 2916

SEQ ID NO: 2964 - DNA, 201 bp, Homo sapiens; identical to SEQ ID NO: 2917

SEQ ID NO: 2965 - DNA, 201 bp, Homo sapiens; identical to SEQ ID NO: 2918

SEQ ID NO: 2966 - DNA, 201 bp, Homo sapiens; identical to SEQ ID NO: 2919

SEQ ID NO: 2967 - DNA, 201 bp, Homo sapiens; identical to SEQ ID NO: 2920

SEQ ID NO: 2968 - DNA, 201 bp, Homo sapiens; identical to SEQ ID NO: 2921

SEQ ID NO: 2969 - DNA, 201 bp, Homo sapiens; identical to SEQ ID NO: 2922

SEQ ID NO: 2970 - DNA, 201 bp, Homo sapiens; identical to SEQ ID NO: 2923

SEQ ID NO: 2971 - DNA, 201 bp, Homo sapiens; identical to SEQ ID NO: 2876

SEQ ID NO: 2972 - DNA, 201 bp, Homo sapiens; identical to SEQ ID NO: 2877

SEQ ID NO: 2973 - DNA, 201 bp, Homo sapiens; identical to SEQ ID NO: 2878

SEQ ID NO: 2974 - DNA, 201 bp, Homo sapiens; identical to SEQ ID NO: 2879

SEQ ID NO: 2975 - DNA, 201 bp, Homo sapiens; identical to SEQ ID NO: 2880

SEQ ID NO: 2976 - DNA, 181 bp, Homo sapiens; identical to SEQ ID NO: 2929

SEQ ID NO: 2977 - DNA, 180 bp, Homo sapiens; identical to SEQ ID NO: 2930

SEQ ID NO: 2978 - DNA, 201 bp, Homo sapiens; identical to SEQ ID NO: 2884

SEQ ID NO: 2979 - DNA, 201 bp, Homo sapiens; identical to SEQ ID NO: 2931

SEQ ID NO: 2980 - DNA, 201 bp, Homo sapiens; identical to SEQ ID NO: 2885

SEQ ID NO: 2981 - DNA, 201 bp, Homo sapiens
ctacgtgggcggtgccctgcatgccctacccactggcctcagggggctactccgcccttcaccccccttctccaaacctctgttttgggctgggctgaggkagctgaccaagccccggggcaaagagcctgatgagactgtgcacagttttgcccagcgccgccttggacctgaggtggcgtctctagccatggacagtct

SEQ ID NO: 2982 - DNA, 201 bp, Homo sapiens; identical to SEQ ID NO: 2886

SEQ ID NO: 2983 - DNA, 201 bp, Homo sapiens
cccttctccaaacctctgttttgggctgggctgagggagctgaccaagccccggggcaaagagcctgatgagactgtgcacagttttgcccagcgccgccytggacctgaggtggcgtctctagccatggacagtctctgccgtggagtgtttgcaggcaacagccgtgagctcagcatcaggtcctgctttcccagtctc

SEQ ID NO: 2984 - DNA, 201 bp, Homo sapiens; identical to SEQ ID NO: 2889

SEQ ID NO: 2985 - DNA, 201 bp, Homo sapiens; identical to SEQ ID NO: 2890

SEQ ID NO: 2986 - DNA, 201 bp, Homo sapiens; identical to SEQ ID NO: 2891

SEQ ID NO: 2987 - DNA, 201 bp, Homo sapiens; identical to SEQ ID NO: 2892

SEQ ID NO: 2988 - DNA, 201 bp, Homo sapiens
cccttcaccccccttctccaaacctctgttttgggctgggctgagggagctgaccaagccccggggcaaagagcctgatgagactgtgcacagttttgccyagcgccgccttggacctgaggtggcgtctctagccatggacagtctctgccgtggagtgtttgcaggcaacagccgtgagctcagcatcaggtcctgctt

SEQ ID NO: 2989 - DNA, 201 bp, Homo sapiens
agaacaggttcctctacgtgggcggtgccctgcatgccctacccactggcctcagggggctactccgcccttcaccccccttctccaaacctctgttttgrgctgggctgagggagctgaccaagccccggggcaaagagcctgatgagactgtgcacagttttgcccagcgccgccttggacctgaggtggcgtctctag

SEQ ID NO: 2990 - DNA, 201 bp, Homo sapiens
ctgcatgccctacccactggcctcagggggctactccgcccttcaccccccttctccaaacctctgttttgggctgggctgagggagctgaccaagccccsgggcaaagagcctgatgagactgtgcacagttttgcccagcgccgccttggacctgaggtggcgtctctagccatggacagtctctgccgtggagtgttt

SEQ ID NO: 2991 - DNA, 201 bp, Homo sapiens
actggcctcagggggctactccgcccttcaccccccttctccaaacctctgttttgggctgggctgagggagctgaccaagccccggggcaaagagcctgwtgagactgtgcacagttttgcccagcgccgccttggacctgaggtggcgtctctagccatggacagtctctgccgtggagtgtttgcaggcaacagccgt

SEQ ID NO: 2992 - DNA, 201 bp, Homo sapiens; identical to SEQ ID NO: 2897

SEQ ID NO: 2993 - DNA, 201 bp, Homo sapiens; identical to SEQ ID NO: 2899

SEQ ID NO: 2994 - DNA, 201 bp, Homo sapiens
ttcaccccccttctccaaacctctgttttgggctgggctgagggagctgaccaagccccggggcaaagagcctgatgagactgtgcacagttttgcccagygccgccttggacctgaggtggcgtctctagccatggacagtctctgccgtggagtgtttgcaggcaacagccgtgagctcagcatcaggtcctgctttcc

SEQ ID NO: 2995 - DNA, 201 bp, Homo sapiens
acctctgttttgggctgggctgagggagctgaccaagccccggggcaaagagcctgatgagactgtgcacagttttgcccagcgccgccttggacctgagvtggcgtctctagccatggacagtctctgccgtggagtgtttgcaggcaacagccgtgagctcagcatcaggtcctgctttcccagtctcttccaagctga

SEQ ID NO: 2996 - DNA, 201 bp, Homo sapiens; identical to SEQ ID NO: 2901

SEQ ID NO: 2997 - DNA, 201 bp, Homo sapiens; identical to SEQ ID NO: 2902

SEQ ID NO: 2998 - DNA, 201 bp, Homo sapiens
gactgtgcacagttttgcccagcgccgccttggacctgaggtggcgtctctagccatggacagtctctgccgtggagtgtttgcaggcaacagccgtgagstcagcatcaggtcctgctttcccagtctcttccaagctgagcaaacccatcgttccatattactgggcctgctgctgggggcagggcggaccccacagcc

SEQ ID NO: 2999 - DNA, 201 bp, Homo sapiens; identical to SEQ ID NO: 2905

SEQ ID NO: 3000 - DNA, 201 bp, Homo sapiens; identical to SEQ ID NO: 2953

SEQ ID NO: 3001 - DNA, 201 bp, Homo sapiens; identical to SEQ ID NO: 2907

SEQ ID NO: 3002 - DNA, 201 bp, Homo sapiens; identical to SEQ ID NO: 2908

SEQ ID NO: 3003 - DNA, 201 bp, Homo sapiens; identical to SEQ ID NO: 2909

SEQ ID NO: 3004 - DNA, 201 bp, Homo sapiens; identical to SEQ ID NO: 2910

SEQ ID NO: 3005 - DNA, 201 bp, Homo sapiens; identical to SEQ ID NO: 2911

SEQ ID NO: 3006 - DNA, 201 bp, Homo sapiens; identical to SEQ ID NO: 2912

SEQ ID NO: 3007 - DNA, 201 bp, Homo sapiens; identical to SEQ ID NO: 2913

SEQ ID NO: 3008 - DNA, 201 bp, Homo sapiens; identical to SEQ ID NO: 2915

SEQ ID NO: 3009 - DNA, 201 bp, Homo sapiens; identical to SEQ ID NO: 2914

SEQ ID NO: 3010 - DNA, 201 bp, Homo sapiens; identical to SEQ ID NO: 2916

SEQ ID NO: 3011 - DNA, 201 bp, Homo sapiens
ggcaaagagcctgatgagactgtgcacagttttgcccagcgccgccttggacctgaggtggcgtctctagccatggacagtctctgccgtggagtgtttgyaggcaacagccgtgagctcagcatcaggtcctgctttcccagtctcttccaagctgagcaaacccatcgttccatattactgggcctgctgctgggggca

SEQ ID NO: 3012 - DNA, 201 bp, Homo sapiens; identical to SEQ ID NO: 2919

SEQ ID NO: 3013 - DNA, 201 bp, Homo sapiens
acctgaggtggcgtctctagccatggacagtctctgccgtggagtgtttgcaggcaacagccgtgagctcagcatcaggtcctgctttcccagtctcttcyaagctgagcaaacccatcgttccatattactgggcctgctgctgggggcagggcggaccccacagccagactcagcactcattcgccaggccttggctga

SEQ ID NO: 3014 - DNA, 201 bp, Homo sapiens; identical to SEQ ID NO: 2920

SEQ ID NO: 3015 - DNA, 201 bp, Homo sapiens; identical to SEQ ID NO: 2921

SEQ ID NO: 3016 - DNA, 201 bp, Homo sapiens; identical to SEQ ID NO: 2922

SEQ ID NO: 3017 - DNA, 134 bp, Homo sapiens; identical to SEQ ID NO: 2874

SEQ ID NO: 3018 - DNA, 201 bp, Homo sapiens; identical to SEQ ID NO: 2875

SEQ ID NO: 3019 - DNA, 201 bp, Homo sapiens; identical to SEQ ID NO: 2876

SEQ ID NO: 3020 - DNA, 201 bp, Homo sapiens; identical to SEQ ID NO: 2877

SEQ ID NO: 3021 - DNA, 201 bp, Homo sapiens; identical to SEQ ID NO: 2878

SEQ ID NO: 3022 - DNA, 201 bp, Homo sapiens; identical to SEQ ID NO: 2879

SEQ ID NO: 3023 - DNA, 201 bp, Homo sapiens; identical to SEQ ID NO: 2880

SEQ ID NO: 3024 - DNA, 201 bp, Homo sapiens; identical to SEQ ID NO: 2881

SEQ ID NO: 3025 - DNA, 201 bp, Homo sapiens; identical to SEQ ID NO: 2882

SEQ ID NO: 3026 - DNA, 201 bp, Homo sapiens; identical to SEQ ID NO: 2884

SEQ ID NO: 3027 - DNA, 201 bp, Homo sapiens; identical to SEQ ID NO: 2883

SEQ ID NO: 3028 - DNA, 201 bp, Homo sapiens; identical to SEQ ID NO: 2885

SEQ ID NO: 3029 - DNA, 201 bp, Homo sapiens; identical to SEQ ID NO: 2981

SEQ ID NO: 3030 - DNA, 201 bp, Homo sapiens; identical to SEQ ID NO: 2886

SEQ ID NO: 3031 - DNA, 201 bp, Homo sapiens; identical to SEQ ID NO: 2983

SEQ ID NO: 3032 - DNA, 201 bp, Homo sapiens; identical to SEQ ID NO: 2889

SEQ ID NO: 3033 - DNA, 201 bp, Homo sapiens; identical to SEQ ID NO: 2890

SEQ ID NO: 3034 - DNA, 201 bp, Homo sapiens; identical to SEQ ID NO: 2891

SEQ ID NO: 3035 - DNA, 201 bp, Homo sapiens; identical to SEQ ID NO: 2892

SEQ ID NO: 3036 - DNA, 201 bp, Homo sapiens; identical to SEQ ID NO: 2988

SEQ ID NO: 3037 - DNA, 201 bp, Homo sapiens; identical to SEQ ID NO: 2989

SEQ ID NO: 3038 - DNA, 201 bp, Homo sapiens; identical to SEQ ID NO: 2990

SEQ ID NO: 3039 - DNA, 201 bp, Homo sapiens; identical to SEQ ID NO: 2991

SEQ ID NO: 3040 - DNA, 201 bp, Homo sapiens; identical to SEQ ID NO: 2897

SEQ ID NO: 3041 - DNA, 201 bp, Homo sapiens; identical to SEQ ID NO: 2899

SEQ ID NO: 3042 - DNA, 201 bp, Homo sapiens; identical to SEQ ID NO: 2994

SEQ ID NO: 3043 - DNA, 201 bp, Homo sapiens; identical to SEQ ID NO: 2995

SEQ ID NO: 3044 - DNA, 201 bp, Homo sapiens; identical to SEQ ID NO: 2901

SEQ ID NO: 3045 - DNA, 201 bp, Homo sapiens; identical to SEQ ID NO: 2902

SEQ ID NO: 3046 - DNA, 201 bp, Homo sapiens; identical to SEQ ID NO: 2903

SEQ ID NO: 3047 - DNA, 201 bp, Homo sapiens; identical to SEQ ID NO: 2998

SEQ ID NO: 3048 - DNA, 201 bp, Homo sapiens; identical to SEQ ID NO: 2905

SEQ ID NO: 3049 - DNA, 201 bp, Homo sapiens; identical to SEQ ID NO: 2906

SEQ ID NO: 3050 - DNA, 201 bp, Homo sapiens; identical to SEQ ID NO: 2907

SEQ ID NO: 3051 - DNA, 201 bp, Homo sapiens; identical to SEQ ID NO: 2908

SEQ ID NO: 3052 - DNA, 201 bp, Homo sapiens; identical to SEQ ID NO: 2909

SEQ ID NO: 3053 - DNA, 201 bp, Homo sapiens; identical to SEQ ID NO: 2910

SEQ ID NO: 3054 - DNA, 201 bp, Homo sapiens; identical to SEQ ID NO: 2911

SEQ ID NO: 3055 - DNA, 201 bp, Homo sapiens; identical to SEQ ID NO: 2912

SEQ ID NO: 3056 - DNA, 201 bp, Homo sapiens; identical to SEQ ID NO: 2913

SEQ ID NO: 3057 - DNA, 201 bp, Homo sapiens; identical to SEQ ID NO: 2915

SEQ ID NO: 3058 - DNA, 201 bp, Homo sapiens; identical to SEQ ID NO: 2914

SEQ ID NO: 3059 - DNA, 201 bp, Homo sapiens; identical to SEQ ID NO: 2916

SEQ ID NO: 3060 - DNA, 201 bp, Homo sapiens; identical to SEQ ID NO: 3011

SEQ ID NO: 3061 - DNA, 201 bp, Homo sapiens; identical to SEQ ID NO: 2919

SEQ ID NO: 3062 - DNA, 201 bp, Homo sapiens; identical to SEQ ID NO: 3013

SEQ ID NO: 3063 - DNA, 201 bp, Homo sapiens; identical to SEQ ID NO: 2920

SEQ ID NO: 3064 - DNA, 201 bp, Homo sapiens; identical to SEQ ID NO: 2921

SEQ ID NO: 3065 - DNA, 201 bp, Homo sapiens; identical to SEQ ID NO: 2922

SEQ ID NO: 3066 - DNA, 134 bp, Homo sapiens; identical to SEQ ID NO: 2874

SEQ ID NO: 3067 - DNA, 201 bp, Homo sapiens; identical to SEQ ID NO: 2875

SEQ ID NO: 3068 - DNA, 201 bp, Homo sapiens; identical to SEQ ID NO: 2876

SEQ ID NO: 3069 - DNA, 201 bp, Homo sapiens
aaggacatcagacccccagctaaaacattcctttcatcctttccttccagagtcagctaggcaattcctgactgctcacaggttgcccctgactctggctrgagcctcctatgagggagttgctgttaatgactgtatagagagtgggcgccaggcagcagtcagtgtcctgggcacagaacctaacagctgatccccaac

SEQ ID NO: 3070 - DNA, 201 bp, Homo sapiens; identical to SEQ ID NO: 2878

SEQ ID NO: 3071 - DNA, 201 bp, Homo sapiens; identical to SEQ ID NO: 2879

SEQ ID NO: 3072 - DNA, 201 bp, Homo sapiens; identical to SEQ ID NO: 2880

SEQ ID NO: 3073 - DNA, 201 bp, Homo sapiens; identical to SEQ ID NO: 2881

SEQ ID NO: 3074 - DNA, 201 bp, Homo sapiens; identical to SEQ ID NO: 2882

SEQ ID NO: 3075 - DNA, 201 bp, Homo sapiens
tgctgggaggttcctggttacagacactggaggctagtggctgtgtcttatctcaggagctgtttcaacagcgggcccaggaagcagctgctacacaattmggactgaaggagatgccgagccactgcttggtccatctacacaagaactgcattccccagtatacactaggtcactggcaaaaactaggtaagttgggaa

SEQ ID NO: 3076 - DNA, 201 bp, Homo sapiens; identical to SEQ ID NO: 2883

SEQ ID NO: 3077 - DNA, 201 bp, Homo sapiens; identical to SEQ ID NO: 2885

SEQ ID NO: 3078 - DNA, 201 bp, Homo sapiens; identical to SEQ ID NO: 2981

SEQ ID NO: 3079 - DNA, 201 bp, Homo sapiens; identical to SEQ ID NO: 2886

SEQ ID NO: 3080 - DNA, 201 bp, Homo sapiens; identical to SEQ ID NO: 2983

SEQ ID NO: 3081 - DNA, 201 bp, Homo sapiens; identical to SEQ ID NO: 2889

SEQ ID NO: 3082 - DNA, 201 bp, Homo sapiens; identical to SEQ ID NO: 2890

SEQ ID NO: 3083 - DNA, 201 bp, Homo sapiens; identical to SEQ ID NO: 2891

SEQ ID NO: 3084 - DNA, 201 bp, Homo sapiens; identical to SEQ ID NO: 2892

SEQ ID NO: 3085 - DNA, 201 bp, Homo sapiens; identical to SEQ ID NO: 2988

SEQ ID NO: 3086 - DNA, 201 bp, Homo sapiens; identical to SEQ ID NO: 2989

SEQ ID NO: 3087 - DNA, 201 bp, Homo sapiens; identical to SEQ ID NO: 2991

SEQ ID NO: 3088 - DNA, 201 bp, Homo sapiens; identical to SEQ ID NO: 2990

SEQ ID NO: 3089 - DNA, 201 bp, Homo sapiens; identical to SEQ ID NO: 2897

SEQ ID NO: 3090 - DNA, 201 bp, Homo sapiens; identical to SEQ ID NO: 2899

SEQ ID NO: 3091 - DNA, 201 bp, Homo sapiens; identical to SEQ ID NO: 2994

SEQ ID NO: 3092 - DNA, 201 bp, Homo sapiens; identical to SEQ ID NO: 2995

SEQ ID NO: 3093 - DNA, 201 bp, Homo sapiens; identical to SEQ ID NO: 2901

SEQ ID NO: 3094 - DNA, 201 bp, Homo sapiens; identical to SEQ ID NO: 2902

SEQ ID NO: 3095 - DNA, 201 bp, Homo sapiens; identical to SEQ ID NO: 2903

SEQ ID NO: 3096 - DNA, 201 bp, Homo sapiens; identical to SEQ ID NO: 2998

SEQ ID NO: 3097 - DNA, 201 bp, Homo sapiens; identical to SEQ ID NO: 2905

SEQ ID NO: 3098 - DNA, 201 bp, Homo sapiens; identical to SEQ ID NO: 2906

SEQ ID NO: 3099 - DNA, 201 bp, Homo sapiens; identical to SEQ ID NO: 2907

SEQ ID NO: 3100 - DNA, 201 bp, Homo sapiens; identical to SEQ ID NO: 2908

SEQ ID NO: 3101 - DNA, 201 bp, Homo sapiens; identical to SEQ ID NO: 2909

SEQ ID NO: 3102 - DNA, 201 bp, Homo sapiens; identical to SEQ ID NO: 2910

SEQ ID NO: 3103 - DNA, 201 bp, Homo sapiens; identical to SEQ ID NO: 2911

SEQ ID NO: 3104 - DNA, 201 bp, Homo sapiens
gcaaaaactaggtaagttgggaaaacagctgggctgaggagggccaaggacatcagacccccagctaaaacattcctttcatcctttccttccagagtcasctaggcaattcctgactgctcacaggttgcccctgactctggctggagcctcctatgagggagttgctgttaatgactgtatagagagtgggcgccaggc

SEQ ID NO: 3105 - DNA, 201 bp, Homo sapiens
actaggtaagttgggaaaacagctgggctgaggagggccaaggacatcagacccccagctaaaacattcctttcatcctttccttccagagtcagctaggyaattcctgactgctcacaggttgcccctgactctggctggagcctcctatgagggagttgctgttaatgactgtatagagagtgggcgccaggcagcagt

SEQ ID NO: 3106 - DNA, 201 bp, Homo sapiens; identical to SEQ ID NO: 2914

SEQ ID NO: 3107 - DNA, 201 bp, Homo sapiens
atcagacccccagctaaaacattcctttcatcctttccttccagagtcagctaggcaattcctgactgctcacaggttgcccctgactctggctggagccycctatgagggagttgctgttaatgactgtatagagagtgggcgccaggcagcagtcagtgtcctgggcacagaacctaacagctgatccccaactctcat

SEQ ID NO: 3108 - DNA, 201 bp, Homo sapiens; identical to SEQ ID NO: 2916

SEQ ID NO: 3109 - DNA, 201 bp, Homo sapiens; identical to SEQ ID NO: 3011

SEQ ID NO: 3110 - DNA, 201 bp, Homo sapiens; identical to SEQ ID NO: 3013

SEQ ID NO: 3111 - DNA, 201 bp, Homo sapiens
cagctaaaacattcctttcatcctttccttccagagtcagctaggcaattcctgactgctcacaggttgcccctgactctggctggagcctcctatgaggkagttgctgttaatgactgtatagagagtgggcgccaggcagcagtcagtgtcctgggcacagaacctaacagctgatccccaactctcattcatgaaaat

SEQ ID NO: 3112 - DNA, 201 bp, Homo sapiens; identical to SEQ ID NO: 2921

SEQ ID NO: 3113 - DNA, 201 bp, Homo sapiens
ccagctaaaacattcctttcatcctttccttccagagtcagctaggcaattcctgactgctcacaggttgcccctgactctggctggagcctcctatgagrgagttgctgttaatgactgtatagagagtgggcgccaggcagcagtcagtgtcctgggcacagaacctaacagctgatccccaactctcattcatgaaaa

SEQ ID NO: 3114 - DNA, 201 bp, Homo sapiens; identical to SEQ ID NO: 2922

SEQ ID NO: 3115 - DNA, 134 bp, Homo sapiens; identical to SEQ ID NO: 2874

SEQ ID NO: 3116 - DNA, 201 bp, Homo sapiens; identical to SEQ ID NO: 2875

SEQ ID NO: 3117 - DNA, 201 bp, Homo sapiens; identical to SEQ ID NO: 2876

SEQ ID NO: 3118 - DNA, 201 bp, Homo sapiens; identical to SEQ ID NO: 2877

SEQ ID NO: 3119 - DNA, 201 bp, Homo sapiens
ctgcccccctaaggtggtcctagtggagagcagtgagcgtctgggaggctggattcgctccgttcgaggccctaatggtgctatctttgagcttggacctyggggaattaggccagcgggagccctaggggcccggaccttgctcctgggggctactccgcccttcaccccccttctccaaacctctgttttgggctgggc

SEQ ID NO: 3120 - DNA, 201 bp, Homo sapiens
ggaggctggattcgctccgttcgaggccctaatggtgctatctttgagcttggacctcggggaattaggccagcgggagccctaggggcccggaccttgcycctgggggctactccgcccttcaccccccttctccaaacctctgttttgggctgggctgagggagctgaccaagccccggggcaaagagcctgatgagac

SEQ ID NO: 3121 - DNA, 201 bp, Homo sapiens; identical to SEQ ID NO: 2880

SEQ ID NO: 3122 - DNA, 201 bp, Homo sapiens; identical to SEQ ID NO: 2881

SEQ ID NO: 3123 - DNA, 201 bp, Homo sapiens; identical to SEQ ID NO: 2882

SEQ ID NO: 3124 - DNA, 201 bp, Homo sapiens; identical to SEQ ID NO: 2883

SEQ ID NO: 3125 - DNA, 201 bp, Homo sapiens; identical to SEQ ID NO: 2884

SEQ ID NO: 3126 - DNA, 201 bp, Homo sapiens; identical to SEQ ID NO: 2885

SEQ ID NO: 3127 - DNA, 201 bp, Homo sapiens
attaggccagcgggagccctaggggcccggaccttgctcctgggggctactccgcccttcaccccccttctccaaacctctgttttgggctgggctgaggkagctgaccaagccccggggcaaagagcctgatgagactgtgcacagttttgcccagcgccgccttggacctgaggtggcgtctctagccatggacagtct

SEQ ID NO: 3128 - DNA, 201 bp, Homo sapiens; identical to SEQ ID NO: 2983

SEQ ID NO: 3129 - DNA, 201 bp, Homo sapiens; identical to SEQ ID NO: 2889

SEQ ID NO: 3130 - DNA, 201 bp, Homo sapiens; identical to SEQ ID NO: 2890

SEQ ID NO: 3131 - DNA, 201 bp, Homo sapiens; identical to SEQ ID NO: 2891

SEQ ID NO: 3132 - DNA, 201 bp, Homo sapiens; identical to SEQ ID NO: 2892

SEQ ID NO: 3133 - DNA, 201 bp, Homo sapiens; identical to SEQ ID NO: 2988

SEQ ID NO: 3134 - DNA, 201 bp, Homo sapiens
tggacctcggggaattaggccagcgggagccctaggggcccggaccttgctcctgggggctactccgcccttcaccccccttctccaaacctctgttttgrgctgggctgagggagctgaccaagccccggggcaaagagcctgatgagactgtgcacagttttgcccagcgccgccttggacctgaggtggcgtctctag

SEQ ID NO: 3135 - DNA, 201 bp, Homo sapiens
ccctaggggcccggaccttgctcctgggggctactccgcccttcaccccccttctccaaacctctgttttgggctgggctgagggagctgaccaagccccsgggcaaagagcctgatgagactgtgcacagttttgcccagcgccgccttggacctgaggtggcgtctctagccatggacagtctctgccgtggagtgttt

SEQ ID NO: 3136 - DNA, 201 bp, Homo sapiens
ccttgctcctgggggctactccgcccttcaccccccttctccaaacctctgttttgggctgggctgagggagctgaccaagccccggggcaaagagcctgwtgagactgtgcacagttttgcccagcgccgccttggacctgaggtggcgtctctagccatggacagtctctgccgtggagtgtttgcaggcaacagccgt

SEQ ID NO: 3137 - DNA, 201 bp, Homo sapiens; identical to SEQ ID NO: 2897

SEQ ID NO: 3138 - DNA, 201 bp, Homo sapiens; identical to SEQ ID NO: 2899

SEQ ID NO: 3139 - DNA, 201 bp, Homo sapiens; identical to SEQ ID NO: 2994

SEQ ID NO: 3140 - DNA, 201 bp, Homo sapiens; identical to SEQ ID NO: 2995

SEQ ID NO: 3141 - DNA, 201 bp, Homo sapiens; identical to SEQ ID NO: 2901

SEQ ID NO: 3142 - DNA, 201 bp, Homo sapiens; identical to SEQ ID NO: 2902

SEQ ID NO: 3143 - DNA, 201 bp, Homo sapiens; identical to SEQ ID NO: 2903

SEQ ID NO: 3144 - DNA, 201 bp, Homo sapiens; identical to SEQ ID NO: 2998

SEQ ID NO: 3145 - DNA, 201 bp, Homo sapiens; identical to SEQ ID NO: 2905

SEQ ID NO: 3146 - DNA, 201 bp, Homo sapiens; identical to SEQ ID NO: 2906

SEQ ID NO: 3147 - DNA, 201 bp, Homo sapiens; identical to SEQ ID NO: 2907

SEQ ID NO: 3148 - DNA, 201 bp, Homo sapiens; identical to SEQ ID NO: 2908

SEQ ID NO: 3149 - DNA, 201 bp, Homo sapiens; identical to SEQ ID NO: 2909

SEQ ID NO: 3150 - DNA, 201 bp, Homo sapiens; identical to SEQ ID NO: 2910

SEQ ID NO: 3151 - DNA, 201 bp, Homo sapiens; identical to SEQ ID NO: 2911

SEQ ID NO: 3152 - DNA, 201 bp, Homo sapiens; identical to SEQ ID NO: 2912

SEQ ID NO: 3153 - DNA, 201 bp, Homo sapiens; identical to SEQ ID NO: 2913

SEQ ID NO: 3154 - DNA, 201 bp, Homo sapiens; identical to SEQ ID NO: 2914

SEQ ID NO: 3155 - DNA, 201 bp, Homo sapiens; identical to SEQ ID NO: 2915

SEQ ID NO: 3156 - DNA, 201 bp, Homo sapiens; identical to SEQ ID NO: 2916

SEQ ID NO: 3157 - DNA, 201 bp, Homo sapiens; identical to SEQ ID NO: 3011

SEQ ID NO: 3158 - DNA, 201 bp, Homo sapiens; identical to SEQ ID NO: 3013

SEQ ID NO: 3159 - DNA, 201 bp, Homo sapiens; identical to SEQ ID NO: 2919

SEQ ID NO: 3160 - DNA, 201 bp, Homo sapiens; identical to SEQ ID NO: 2920

SEQ ID NO: 3161 - DNA, 201 bp, Homo sapiens; identical to SEQ ID NO: 2921

SEQ ID NO: 3162 - DNA, 201 bp, Homo sapiens; identical to SEQ ID NO: 2922

SEQ ID NO: 3163 - DNA, 201 bp, Homo sapiens
aacttggtgagaattaaaattgacctttgggagagggtaggggcaggatgttttatgacactgtagaaaagacaggaggaacccgctgcgatggagattgsggggagctggaagcaagcagccaacaggacagagttccagaactcatgcagatggggaagaggtgacagcccttccccactggcctcccccgtggaggtg

SEQ ID NO: 3164 - DNA, 201 bp, Homo sapiens
catacagagatgtgcaaaacttggtgagaattaaaattgacctttgggagagggtaggggcaggatgttttatgacactgtagaaaagacaggaggaaccygctgcgatggagattggggggagctggaagcaagcagccaacaggacagagttccagaactcatgcagatggggaagaggtgacagcccttccccactgg

SEQ ID NO: 3165 - DNA, 201 bp, Homo sapiens
tcagaccccacggcaggtaaaatcaggactgcctgagaacccgtcaccctctgcctctcaggtcaccccccagctccaggaacctgcctcctgctgtccaytgccaggtcttccttgcaccctgacacctgtgctgaggcgctctggcagctggaggaggctgattgcactccacaaacaggactgtctggaccaagggaa

SEQ ID NO: 3166 - DNA, 201 bp, Homo sapiens
tgtaaacaggcccattcagggctgcctgagcaaatggggacttgccgaggcagctgcaactagacttgggctaagccgtctgggtctactcaagaattcgmgtctgaagatgaccaagcttgagttattcaactgagagtgaggtgtcaaggcggaagcgactgtccccagggaagggctgtgagatggatgggcgtgagt

SEQ ID NO: 3167 - DNA, 201 bp, Homo sapiens
cctccctcggagagcagggtctctcggcatccagcggcgtggtctgcattctgctctacctcatgctctaggccccatgccatcgtctcggccctagaccrtgaaaactgccagtcacccgggacctgctcctaggggctggcctgcacagccggatggcctgtgggcggggtggaagtgcccactcccactccagatggg

SEQ ID NO: 3168 - DNA, 201 bp, Homo sapiens
aggtgtcaaggcggaagcgactgtccccagggaagggctgtgagatggatgggcgtgagtcagcttttccaaaactcaagtacctgggacaggacaactcrctagcagctcagtcacctccgtggcggacacagataaggatgttaagaccagaaaaccagagactagggccccgtcctcagccctcacagcatgacacag

SEQ ID NO: 3169 - DNA, 201 bp, Homo sapiens
tccccactggcctcccccgtggaggtggagtagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgagg

SEQ ID NO: 3170 - DNA, 201 bp, Homo sapiens; identical to SEQ ID NO: 3165

SEQ ID NO: 3171 - DNA, 201 bp, Homo sapiens; identical to SEQ ID NO: 3166

SEQ ID NO: 3172 - DNA, 201 bp, Homo sapiens; identical to SEQ ID NO: 3167

SEQ ID NO: 3173 - DNA, 201 bp, Homo sapiens; identical to SEQ ID NO: 3168

SEQ ID NO: 3174 - DNA, 201 bp, Homo sapiens
gggctgtcctgacagcacagacgcttcagggagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgagg

SEQ ID NO: 3175 - DNA, 201 bp, Homo sapiens
atactggaaatggttatgggccaaatggatgtgtgcagctcagtaatatttgcctaagtcacccctgtctaaatggacaatgcatcgacactgtctctggytatttttgtaagtgtgactcaggttggacaggtgtcaactgtacagaaaacatcaatgagtgtttgagcaacccctgtttgaatggaggaacttgtgttg

SEQ ID NO: 3176 - DNA, 201 bp, Homo sapiens
cagtaatggaggctgccacccagatgcctcatgctcctcaactctaggttccttacctctctgcacgtgtctcccgggttatactggaaatggttatgggmcaaatggatgtgtgcagctcagtaatatttgcctaagtcacccctgtctaaatggacaatgcatcgacactgtctctggttatttttgtaagtgtgactc

SEQ ID NO: 3177 - DNA, 201 bp, Homo sapiens
catctcaaaaaaaaaagaaacaaaaaaaaccagaatcaatatttgtacattttctcgaacatagaatatagcttctttagtcttgagtgtgcatttcattmtaatattttgagctgaaatttaaaaaaactttgaaagagttggaaatgattatggcatatgtgacatacgtttttaaaagttaataataatagccagggg

SEQ ID NO: 3178 - DNA, 201 bp, Homo sapiens
ggttctgtggcacgctgtgtccatggcatctgtgaggatttaatgcgagagcaagctggagagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctct

SEQ ID NO: 3179 - DNA, 201 bp, Homo sapiens
acctatcagattgcagattgcaacagagactatcacaaggcatttggcaacctgagaagccctggatggccagataactacgacaatgacaaggattgcaycgttactctcacagccccccagaaccacaccatttccctcttttttcattcacttggcatcgagaactcagttgaatgcagaaacgatttcttggaggtg

SEQ ID NO: 3180 - DNA, 201 bp, Homo sapiens
gcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaaggatctatgatgggcctagcattc

SEQ ID NO: 3181 - DNA, 201 bp, Homo sapiens
ctggtaacttccttacggttcaattcatcagtgacttaacattagagagggaaggatttaatgctacatacaccatcatggacatgccttgtggtggaacrtacaatgcaacttggaccccacaaaatatttcatcacccaattcatcagacccagatgtcccattttccatctgtacttgggtcattgattcccctccgc

SEQ ID NO: 3182 - DNA, 201 bp, Homo sapiens
gttctacatggctgaaggcatcttcaacagccctggctacccagacatttatccccctaatgtggaatgtgtctggaacatcgtcagttcccctggcaacyggctccagctgtcttttatatctttccagttggaagactctcaggactgcagcagagattttgtggagatccgtgaaggaaatgccacgggtcacttggt

SEQ ID NO: 3183 - DNA, 148 bp, Homo sapiens
gttggttggagtggcctcactcttacctgccaacctgggaggttgatkatgaacatgtctttaccttttctttggagtttgcttaccttattaatatttgctgaagtaaatggcgaagctggagaacttgagctgcagagacaaaaaa

SEQ ID NO: 3184 - DNA, 201 bp, Homo sapiens
ggtcagcaaggacgtggcttcaaggctgaataccggcagacatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcac

SEQ ID NO: 3185 - DNA, 201 bp, Homo sapiens
accattgctgtccattttgaacagcctttccagattccaaatggagattcttcttgcaaccagggggattacttggtgctaagaaatggtcctgatatctrttctccacccttgggaccccctggaggaaatggtcatttttgtggcagtcatgcttcatcaactctgttcacctcggataatcaaatgtttgttcagttt

SEQ ID NO: 3186 - DNA, 201 bp, Homo sapiens
cttggtgggacgatactgtggaaactccttccctctcaattattcttccatcgttggacataccctgtgggtcagatttatctcagatggttctggcagcrgcacgggcttccaggccacatttatgaagatatttggcaatgataatattgtgggaactcatgggaaagtcgcctctcctttctggcctgaaaactaccc

SEQ ID NO: 3187 - DNA, 201 bp, Homo sapiens
acaaaaaagaagcatcaatctccaacagcctcgaatggctacagagagaggaaatttggtgtttcttacggggtctgctcaaaacattgagtttagaaccrgatccctgggaaaaattaaattaaatgatgaagatctcagtgagtgtttacatcagatccagaaaaacaaagaagatattatagagttaaaagggagtgc

SEQ ID NO: 3188 - DNA, 201 bp, Homo sapiens
gggtatgtgacctcccccaaccaccctcataattatcccccgcacgctgattgcatttggatcttagcggctccaccggaaacacgcatacagctgcaatktgaagatcgattcgatattgaagtaacacccaactgtacttccaactaccttgagttgcgggatggagtggattcggatgcaccaatactttccaaattt

SEQ ID NO: 3189 - DNA, 201 bp, Homo sapiens
tggaaattctttgacatttcatttttactccgactcttcaatctcagggaagggattccttctggagtggtttgcagtggatgcacctgatggtgttttamctaccattgctccaggtgcttgtggtggcttcctgaggacgggagatgcacccgtgtttctcttctccccgggctggcctgacagttacagtaatagagt

SEQ ID NO: 3190 - DNA, 201 bp, Homo sapiens
tcttacagaatcaacagggaccattcaaagtcctggccatccaaatgtctacccccacggtatcaactgtacttggcatatattagtccaacctaatcacstgattcatttaatgttcgaaacatttcatctggagtttcattacaattgcacaaacgactacttggaagtttatgacaccgactctgagacatcccttgg

SEQ ID NO: 3191 - DNA, 201 bp, Homo sapiens
ttctggaaatcagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggttgcgggggtaatctcaccacttcaa

SEQ ID NO: 3192 - DNA, 201 bp, Homo sapiens
gacatcccttggaagatactgtggaaagtcgatcccgccatctctcacaagcagtggtaactcattgatgctggtgtttgtgactgactccgacctcgctyatgaaggcttcttaataaactatgaagcaatcagtgcagcaacagcatgtttgcaagactacacagatgatttggggacattcacttctccaaacttccc

SEQ ID NO: 3193 - DNA, 201 bp, Homo sapiens
cccagctagagaaactgtgtagtagtgtgaatgtaagcaatgagattaaatcttcaggaaacacaatgaaagtcatttttttcacggatggatccaggccrtatggcggcttcactgcttcctatacctccagtgaagatgcagtgtgtggtgggtctcttccaaatactcctgaaggaaactttacttctcctggctatg

SEQ ID NO: 3194 - DNA, 201 bp, Homo sapiens
agacatcccttggaagatactgtggaaagtcgatcccgccatctctcacaagcagtggtaactcattgatgctggtgtttgtgactgactccgacctcgcytatgaaggcttcttaataaactatgaagcaatcagtgcagcaacagcatgtttgcaagactacacagatgatttggggacattcacttctccaaacttcc

SEQ ID NO: 3195 - DNA, 201 bp, Homo sapiens
gtttcaacactcaaggctctttctactgtggggcctgtccaacaggctggcaaggcaatggatatatttgcgaagatatcaatgaatgtgagataaataayggcggctgttctgtggctccacccgttgagtgtgtgaatacacctgggtcttcccactgccaggcctgtccaccagggtaccagggtgacggaagagtgt

SEQ ID NO: 3196 - DNA, 201 bp, Homo sapiens
gctcgttccgctgtgacgggaagctgtgtcaacgatggcgtgcacattatcagaggttacagcgtcatgtccaccccatttgctactgtgtgtggggatgrgatgccagctcccctcaccatcgctgggccggttctgcttaacttctactccaacgagcaaatcacagacttcggattcaagttttcctataggataatc

SEQ ID NO: 3197 - DNA, 201 bp, Homo sapiens
tcaggtttaaaatagatgcttctgttgaaaaagctagtttcagagctgtttatcaagtcgcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaa

SEQ ID NO: 3198 - DNA, 201 bp, Homo sapiens
agaggctaatcctctgtcagtggtcctcttgacttttgtgtccttccacttagaagctcgttccgctgtgacgggaagctgtgtcaacgatggcgtgcacrttatcagaggttacagcgtcatgtccaccccatttgctactgtgtgtggggatgagatgccagctcccctcaccatcgctgggccggttctgcttaactt

SEQ ID NO: 3199 - DNA, 201 bp, Homo sapiens
tgtggaaacaccattcctgacagcatagacacttctagcaatactgctgtggtcaggtttgtcacagacggctctgtgactgcctcaggattcagactgcratttgaatccagtatggaagagtgtggtggggatcttcagggctctattggaacatttacttctcccaactacccgaacccaaatcctcatggccggatc

SEQ ID NO: 3200 - DNA, 201 bp, Homo sapiens
gcttctttagtcttgagtgtgcatttcattctaatattttgagctgaaatttaaaaaaactttgaaagagttggaaatgattatggcatatgtgacatacrtttttaaaagttaataataatagccaggggcagtggctcatacccataatcccagcacgctgggaggccatgatgggaggattgcttgaacctaggagtt

SEQ ID NO: 3201 - DNA, 201 bp, Homo sapiens
ttcatgctgattatgcacggcgtccatccgcattccgattaacttgggacagctaagtgggtaacaactcgtgttcactcagcactttccctctgcagcaygctggacagcactctgccatcctgatacatgacccctgctgatgccacagagaataagctgaacttgtatggtttttcaccaaaccatggatagaatcaa

SEQ ID NO: 3202 - DNA, 201 bp, Homo sapiens
cctctgcagcacgctggacagcactctgccatcctgatacatgacccctgctgatgccacagagaataagctgaacttgtatggtttttcaccaaaccatrgatagaatcaatatttgtaggccaggcgtggtggctcacccccctgtattctcagcactttgggaggccgaggcaggttgatcacctgaggtcaggagtt

SEQ ID NO: 3203 - DNA, 201 bp, Homo sapiens
ttaccccagtccttataggagcaacacagactgttcttgggtcattcgggttgacagaaatcatcgtgttctcttgaacttcactgactttgatcttgaaycacaagactcttgtattatggcatacgatggcttaagctccacaatgtcccgccttgccaggacgtgtggaagggagcagctggctaaccccatcgtctc

SEQ ID NO: 3204 - DNA, 201 bp, Homo sapiens
gaggctcattcaccagccccggctatccaggcacatacccaaacaacacgtactgcgagtgggtccttgttgctcctgctggaaggcttgtcaccatcaavttctacttcatcagcattgacgatccaggagactgtgtccagaactatctcacactctatgatgggcccaacgccagctctccatcctctggaccatact

SEQ ID NO: 3205 - DNA, 201 bp, Homo sapiens
ctttgtagaaattttggatggcggccacgaagacgcgcccctccgaggccgttactgtggcaccgacatgccccatcctatcacatccttcagcagcgccytgacgctgagattcgtctctgattctagcatcagtgctgggggtttccacaccacggtcaccgcatcagtgtcggcttgtggtggaacgttctacatggc

SEQ ID NO: 3206 - DNA, 201 bp, Homo sapiens
tttggtgtttcttacggggtctgctcaaaacattgagtttagaaccggatccctgggaaaaattaaattaaatgatgaagatctcagtgagtgtttacatyagatccagaaaaacaaagaagatattatagagttaaaagggagtgcaattggtctgcctcaaaatatatctagtcaaatctatcagcttaattccaagct

SEQ ID NO: 3207 - DNA, 201 bp, Homo sapiens
ctggattgttgtaactagtcctgacctcctggtaacatttacttttgggaccttgagcctcgagcaccatgatgactgcaacaaagattaccttgagattygagatggtcctttgtatcaggacccccttcttgggaagttctgcaccactttctctgtcccaccgctccagactactggcccctttgccagaattcactt

SEQ ID NO: 3208 - DNA, 201 bp, Homo sapiens
tattcctttacagattgtggcggaatacagataggtgacagtggagtgatcacaagccccaactatccaaatgcttatgacagcctgacccactgctcttsgctgttggaggccccacaagggcacaccatcactctcacatttagtgactttgatattgaaccccatacaacttgtgcttgggactctgtcactgtcagg

SEQ ID NO: 3209 - DNA, 201 bp, Homo sapiens
tcaagaccgacttgtccataaatgggagaggcttcaatgcgtcatggcaagcagtcactggaggttgtggtgggattttccaggctcccagtggagagatwcattctccaaattaccccagtccttataggagcaacacagactgttcttgggtcattcgggttgacagaaatcatcgtgttctcttgaacttcactgact

SEQ ID NO: 3210 - DNA, 201 bp, Homo sapiens
tatcacaaggcatttggcaacctgagaagccctggatggccagataactacgacaatgacaaggattgcaccgttactctcacagccccccagaaccacascatttccctcttttttcattcacttggcatcgagaactcagttgaatgcagaaacgatttcttggaggtgagaaatggaagtaacagcaattcaccatta

SEQ ID NO: 3211 - DNA, 201 bp, Homo sapiens
acaatgaaagtcatttttttcacggatggatccaggccatatggcggcttcactgcttcctatacctccagtgaagatgcagtgtgtggtgggtctcttcsaaatactcctgaaggaaactttacttctcctggctatgacggagtcaggaattactcaagaaacctgaactgcgaatggactctcagcaatccaaatcag

SEQ ID NO: 3212 - DNA, 201 bp, Homo sapiens
taaaatttaagagtgaccaaatagacacaaggtctggattctcagcttactgggatgggtcatcaacaggttgcgggggtaatctcaccacttcaagcggyacgttcatatctcccaactacccgatgccctattaccacagctctgaatgctactggtggttgaaatctagccacggcagcgcatttgaactggaattca

SEQ ID NO: 3213 - DNA, 201 bp, Homo sapiens
tgctaagaaatggtcctgatatctattctccacccttgggaccccctggaggaaatggtcatttttgtggcagtcatgcttcatcaactctgttcacctcrgataatcaaatgtttgttcagtttatttctgatcacagtaatgaagggcaaggatttaaaatcaaatatgaggcaaagagtttagcctgtgggggcaacg

SEQ ID NO: 3214 - DNA, 201 bp, Homo sapiens
cagctttgacaacaacttcctaatccccagcggtgatggacaatgtcagaatagcttcgtgaaggtgtgggcaggaactgaggaggtggacaaagccctgmtagccactggctgtgggaacgtggctccgggtcccgttatcacaccaagtaacacattcactgccgtcttccagtctcaggaggcaccagctcagggctt

SEQ ID NO: 3215 - DNA, 201 bp, Homo sapiens
acgcccgcctaattggagcttactgtggtacccagactgaatctttcagctccactggaaattctttgacatttcatttttactccgactcttcaatctcrgggaagggattccttctggagtggtttgcagtggatgcacctgatggtgttttacctaccattgctccaggtgcttgtggtggcttcctgaggacgggag

SEQ ID NO: 3216 - DNA, 201 bp, Homo sapiens
gtgtcaacgatggcgtgcacattatcagaggttacagcgtcatgtccaccccatttgctactgtgtgtggggatgagatgccagctcccctcaccatcgcygggccggttctgcttaacttctactccaacgagcaaatcacagacttcggattcaagttttcctataggataatctcctgtggtggtgtgttcaatttct

SEQ ID NO: 3217 - DNA, 201 bp, Homo sapiens
cgccaccgctcccggccgccgcgctccggtacacacaggatccctgctgggcaccaacagctccaccatggggctggcctggggactaggcgtcctgttcytgatgcatgtgtgtggcaccaaccgcattccagagtctggcggagacaacagcgtgtttgacatctttgaactcaccggggccgcccgcaaggggtctgg

SEQ ID NO: 3218 - DNA, 201 bp, Homo sapiens
aataatttatcaggaaatactgcctgtagagttagtatttctatttttatataatgtttgcacactgaattgaagaattgttggttttttcttttttttgktttgtttttttttttttttttttttgcttttgacctcccatttttactatttgccaatacctttttctaggaatgtgcttttttttgtacacatttttat

SEQ ID NO: 3219 - DNA, 201 bp, Homo sapiens
gattgtatgaagaaaatatggaggaactgttacatgttcggtactaagtcattttcaggggattgaaagactattgctggatttcatgatgctgactggcrttagctgattaacccatgtaaataggcacttaaatagaagcaggaaagggagacaaagactggcttctggacttcctccctgatccccacccttactcat

SEQ ID NO: 3220 - DNA, 201 bp, Homo sapiens
ggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggataattgccccaaccttcccaactcagggcaggaagactatgacaaggatgga

SEQ ID NO: 3221 - DNA, 201 bp, Homo sapiens
cacctcccgcttcctgcccggccgccgcccattggccggaggaatccccaggaatgcgagcgcccctttaaaagcgcgcggctcctccgccttgccagccrctgcgcccgagctggcctgcgagttcagggctcctgtcgctctccaggagcaacctctactccggacgcacaggcattccccgcgcccctccagccctcg

SEQ ID NO: 3222 - DNA, 201 bp, Homo sapiens
aaacagactcagcattcagcctccaatgaataagacatcttccaagcatataaacaattgctttggtttccttttgaaaaagcatctacttgcttcagttrggaaggtgcccattccactctgcctttgtcacagagcagggtgctattgtgaggccatctctgagcagtggactcaaaagcattttcaggcatgtcagag

SEQ ID NO: 3223 - DNA, 201 bp, Homo sapiens
gcgatggtcgaggtgatgcctgcaaagatgattttgaccatgacagtgtgccagacatcgatgacatctgtcctgagaatgttgacatcagtgagaccgayttccgccgattccagatgattcctctggaccccaaagggacatcccaaaatgaccctaactgggttgtacgccatcagggtaaagaactcgtccagactg

SEQ ID NO: 3224 - DNA, 201 bp, Homo sapiens
ggaggaatccccaggaatgcgagcgcccctttaaaagcgcgcggctcctccgccttgccagccgctgcgcccgagctggcctgcgagttcagggctcctgycgctctccaggagcaacctctactccggacgcacaggcattccccgcgcccctccagccctcgccgccctcgccaccgctcccggccgccgcgctccggt

SEQ ID NO: 3225 - DNA, 201 bp, Homo sapiens
gctggagccactggtccccgtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccatcaatggaggctggggtccttggtcaccatgggacatct

SEQ ID NO: 3226 - DNA, 201 bp, Homo sapiens
ccccatcaatggaggctggggtccttggtcaccatgggacatctgttctgtcacctgtggaggaggggtacagaaacgtagtcgtctctgcaacaaccccrcaccccagtttggaggcaaggactgcgttggtgatgtaacagaaaaccagatctgcaacaagcaggactgtccaattgatggatgcctgtccaatccctg

SEQ ID NO: 3227 - DNA, 201 bp, Homo sapiens
cctgccccatcaatggaggctggggtccttggtcaccatgggacatctgttctgtcacctgtggaggaggggtacagaaacgtagtcgtctctgcaacaaycccgcaccccagtttggaggcaaggactgcgttggtgatgtaacagaaaaccagatctgcaacaagcaggactgtccaattgatggatgcctgtccaatc

SEQ ID NO: 3228 - DNA, 201 bp, Homo sapiens
atggaattcagcagcgcggccgctcctgcgatagcctcaacaaccgatgtgagggctcctcggtccagacacggacctgccacattcaggagtgtgacaaragatttaaacaggatggtggctggagccactggtccccgtggtcatcttgttctgtgacatgtggtgatggtgtgatcacaaggatccggctctgcaact

SEQ ID NO: 3229 - DNA, 201 bp, Homo sapiens
aatcaatatagcatatacaaaaataaattacagtaagtcatagcaacattcacagtttgtatgtgattgagaaagactgagttgctcaggcctaggcttaraatttgctgcgtttgtggaataaaagaacaaaatgatacattagcctgccatatcaaaaacatataaaagagaaattatccctaagtcaagggcccccat

SEQ ID NO: 3230 - DNA, 201 bp, Homo sapiens
ggaaagatttcaccgcctacagatggcgtctcagccacaggccaaagacgggtttcattagagtggtgatgtatgaagggaagaaaatcatggctgactcrggacccatctatgataaaacctatgctggtggtagactagggttgtttgtcttctctcaagaaatggtgttcttctctgacctgaaatacgaatgtagag

SEQ ID NO: 3231 - DNA, 201 bp, Homo sapiens
tagagatccctaatcatcaaattgttgattgaaagactgatcataaaccaatgctggtattgcaccttctggaactatgggcttgagaaaacccccaggaycacttctccttggcttccttcttttctgtgcttgcatcagtgtggactcctagaacgtgcgacctgcctcaagaaaatgcagttttcaaaaacagactca

SEQ ID NO: 3232 - DNA, 201 bp, Homo sapiens
aggatccctgctgggcaccaacagctccaccatggggctggcctggggactaggcgtcctgttcctgatgcatgtgtgtggcaccaaccgcattccagagkctggcggagacaacagcgtgtttgacatctttgaactcaccggggccgcccgcaaggggtctgggcgccgactggtgaagggccccgacccttccagccc

SEQ ID NO: 3233 - DNA, 201 bp, Homo sapiens
acaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtgactgaagagaacaaagagttggcca

SEQ ID NO: 3234 - DNA, 201 bp, Homo sapiens
acaaccgatgtgagggctcctcggtccagacacggacctgccacattcaggagtgtgacaagagatttaaacaggatggtggctggagccactggtccccrtggtcatcttgttctgtgacatgtggtgatggtgtgatcacaaggatccggctctgcaactctcccagcccccagatgaacgggaaaccctgtgaaggcg

SEQ ID NO: 3235 - DNA, 201 bp, Homo sapiens
ttagcaaacaaaaccaccctgacatcctccttcaggaacacggggagcagaggccaaagcactaaggggagggcgcatacccgagacgattgtatgaagawaatatggaggaactgttacatgttcggtactaagtcattttcaggggattgaaagactattgctggatttcatgatgctgactggcgttagctgattaac

SEQ ID NO: 3236 - DNA, 201 bp, Homo sapiens
agaattgttggttttttcttttttttgttttgtttttttttttttttttttttgcttttgacctcccatttttactatttgccaatacctttttctaggartgtgcttttttttgtacacatttttatccattttacattctaaagcagtgtaagttgtatattactgtttcttatgtacaaggaacaacaataaatcata

SEQ ID NO: 3237 - DNA, 201 bp, Homo sapiens
tttatcaggaaatactgcctgtagagttagtatttctatttttatataatgtttgcacactgaattgaagaattgttggttttttcttttttttgttttgkttttttttttttttttttttgcttttgacctcccatttttactatttgccaatacctttttctaggaatgtgcttttttttgtacacatttttatccatt

SEQ ID NO: 3238 - DNA, 201 bp, Homo sapiens
atacgaatgtagagatccctaatcatcaaattgttgattgaaagactgatcataaaccaatgctggtattgcaccttctggaactatgggcttgagaaaayccccaggatcacttctccttggcttccttcttttctgtgcttgcatcagtgtggactcctagaacgtgcgacctgcctcaagaaaatgcagttttcaaaa

SEQ ID NO: 3239 - DNA, 201 bp, Homo sapiens
tgatctctgaccctcggctcttgtgcttcctgctacaggatccctgctgggcaccaacagctccaccatggggctggcctggggactaggcgtcctgttcytgatgcatgtgtgtggcaccaaccgcattccagagtctggcggagacaacagcgtgtttgacatctttgaactcaccggggccgcccgcaaggggtctgg

SEQ ID NO: 3240 - DNA, 201 bp, Homo sapiens; identical to SEQ ID NO: 3218

SEQ ID NO: 3241 - DNA, 155 bp, Homo sapiens
aagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaa

SEQ ID NO: 3242 - DNA, 201 bp, Homo sapiens; identical to SEQ ID NO: 3219

SEQ ID NO: 3243 - DNA, 201 bp, Homo sapiens; identical to SEQ ID NO: 3220

SEQ ID NO: 3244 - DNA, 201 bp, Homo sapiens; identical to SEQ ID NO: 3222

SEQ ID NO: 3245 - DNA, 201 bp, Homo sapiens; identical to SEQ ID NO: 3223

SEQ ID NO: 3246 - DNA, 201 bp, Homo sapiens; identical to SEQ ID NO: 3225

SEQ ID NO: 3247 - DNA, 201 bp, Homo sapiens; identical to SEQ ID NO: 3226

SEQ ID NO: 3248 - DNA, 201 bp, Homo sapiens; identical to SEQ ID NO: 3227

SEQ ID NO: 3249 - DNA, 201 bp, Homo sapiens; identical to SEQ ID NO: 3228

SEQ ID NO: 3250 - DNA, 201 bp, Homo sapiens; identical to SEQ ID NO: 3229

SEQ ID NO: 3251 - DNA, 201 bp, Homo sapiens; identical to SEQ ID NO: 3230

SEQ ID NO: 3252 - DNA, 201 bp, Homo sapiens; identical to SEQ ID NO: 3231

SEQ ID NO: 3253 - DNA, 201 bp, Homo sapiens; identical to SEQ ID NO: 3232

SEQ ID NO: 3254 - DNA, 201 bp, Homo sapiens; identical to SEQ ID NO: 3233

SEQ ID NO: 3255 - DNA, 201 bp, Homo sapiens; identical to SEQ ID NO: 3234

SEQ ID NO: 3256 - DNA, 201 bp, Homo sapiens; identical to SEQ ID NO: 3235

SEQ ID NO: 3257 - DNA, 201 bp, Homo sapiens; identical to SEQ ID NO: 3236

SEQ ID NO: 3258 - DNA, 201 bp, Homo sapiens; identical to SEQ ID NO: 3237

SEQ ID NO: 3259 - DNA, 201 bp, Homo sapiens; identical to SEQ ID NO: 3238

SEQ ID NO: 3260 - DNA, 201 bp, Homo sapiens; identical to SEQ ID NO: 3239

SEQ ID NO: 3261 - DNA, 201 bp, Homo sapiens; identical to SEQ ID NO: 3218

SEQ ID NO: 3262 - DNA, 201 bp, Homo sapiens; identical to SEQ ID NO: 3219

SEQ ID NO: 3263 - DNA, 201 bp, Homo sapiens; identical to SEQ ID NO: 3220

SEQ ID NO: 3264 - DNA, 201 bp, Homo sapiens; identical to SEQ ID NO: 3221

SEQ ID NO: 3265 - DNA, 201 bp, Homo sapiens; identical to SEQ ID NO: 3222

SEQ ID NO: 3266 - DNA, 201 bp, Homo sapiens; identical to SEQ ID NO: 3223

SEQ ID NO: 3267 - DNA, 201 bp, Homo sapiens; identical to SEQ ID NO: 3224

SEQ ID NO: 3268 - DNA, 201 bp, Homo sapiens; identical to SEQ ID NO: 3225

SEQ ID NO: 3269 - DNA, 201 bp, Homo sapiens; identical to SEQ ID NO: 3226

SEQ ID NO: 3270 - DNA, 201 bp, Homo sapiens; identical to SEQ ID NO: 3227

SEQ ID NO: 3271 - DNA, 201 bp, Homo sapiens; identical to SEQ ID NO: 3228

SEQ ID NO: 3272 - DNA, 201 bp, Homo sapiens; identical to SEQ ID NO: 3229

SEQ ID NO: 3273 - DNA, 201 bp, Homo sapiens; identical to SEQ ID NO: 3230

SEQ ID NO: 3274 - DNA, 201 bp, Homo sapiens; identical to SEQ ID NO: 3231

SEQ ID NO: 3275 - DNA, 201 bp, Homo sapiens; identical to SEQ ID NO: 3232

SEQ ID NO: 3276 - DNA, 201 bp, Homo sapiens; identical to SEQ ID NO: 3233

SEQ ID NO: 3277 - DNA, 201 bp, Homo sapiens; identical to SEQ ID NO: 3234

SEQ ID NO: 3278 - DNA, 201 bp, Homo sapiens; identical to SEQ ID NO: 3235

SEQ ID NO: 3279 - DNA, 201 bp, Homo sapiens; identical to SEQ ID NO: 3236

SEQ ID NO: 3280 - DNA, 201 bp, Homo sapiens; identical to SEQ ID NO: 3237

SEQ ID NO: 3281 - DNA, 201 bp, Homo sapiens; identical to SEQ ID NO: 3238

SEQ ID NO: 3282 - DNA, 201 bp, Homo sapiens
atcaaggagaggtcacctctggcttttattcccttctcggcagggcccaggaactgcatcgggcagacgttcgcgatggcggagatgaaggtggtcctggsgctcacgctgctgcgcttccgcgtcctgcctgaccacaccgagccccgcaggaagccggagctggtcctgcgcgcagagggcggactttggctgcgggtg

SEQ ID NO: 3283 - DNA, 185 bp, Homo sapiens
cagcagacagagagaggaggttgtctgggacagactgctcctgacagaaggatgtcccagctgagcctgtcctggctgggcctckggccagtggcagcatccccttggctgctcctcctgctggtcggggcctcctggctcctggcccatgtcctggcctggacctacgccttctatgacaactg

SEQ ID NO: 3284 - DNA, 187 bp, Homo sapiens
cagcagacagagagaggaggttgtctgggacagactgctcctgacagaaggatgtcccagctgagcctgtcctggctgggcctctgsccagtggcagcatccccttggctgctcctcctgctggtcggggcctcctggctcctggcccatgtcctggcctggacctacgccttctatgacaactgcc

SEQ ID NO: 3285 - DNA, 201 bp, Homo sapiens
aagcagtgatccctactacactgtggatgaaccttgaatgcatgatactgaatgaaagacgtcagatgcaaaaggtcacatagtgtactgtccttttataygaaatttccagaacaggccaatctgaagagatgcatagcggattggtggctttcagcagctgtggggaggtgggactgaggagcgactgctaatcagtat

SEQ ID NO: 3286 - DNA, 201 bp, Homo sapiens
ggtgtttcccacaacccccaagacggaactggttttggggacaccagggcatggtcaaccccacagaggagggcatgagagttctgactcagctggtggcyacctacccccagggctttaaggtctggatgggacccatctcccccctcctcagtttgtgccaccccgacatcatccggtctgtcatcaacgcctcagctg

SEQ ID NO: 3287 - DNA, 189 bp, Homo sapiens
cagcagacagagagaggaggttgtctgggacagactgctcctgacagaaggatgtcccagctgagcctgtcctggctgggcctctggcsagtggcagcatccccttggctgctcctcctgctggtcggggcctcctggctcctggcccatgtcctggcctggacctacgccttctatgacaactgccgc

SEQ ID NO: 3288 - DNA, 201 bp, Homo sapiens
gcctcagctgccattgcaccaaaggacaagttcttctacagcttcctggagccctggctgggggatgggctcctgctgagtgctggtgacaagtggagccrccaccgtcggatgctgacgcctgccttccatttcaacatcctgaagccctatatgaagattttcaatgagagtgtgaacatcatgcacgccaagtggcag

SEQ ID NO: 3289 - DNA, 201 bp, Homo sapiens
tggtggctttcagcagctgtggggaggtgggactgaggagcgactgctaatcagtatggggtttcctcccgggatggtgaaaatgttccggacctagatastgacgaaggtagcacgacactgtgagtgcactaaatgctattgaattggacactttgaaatggtgaatttcgtggtatgtgaattctacctcaatcaaaa

SEQ ID NO: 3290 - DNA, 201 bp, Homo sapiens
gaccctgttccacagtcctgtattccatcctagatatctactcaaaataattgagacaagtgttcaaacagaaagacgcttgtgcgtgaatgttcatggcrgccctattcacagtagccaaacgatgaaaacaaccccaagctatatattaccagatgaaaggataaacaaaatgtggtccatccatacaatggagtatta

SEQ ID NO: 3291 - DNA, 201 bp, Homo sapiens
acgcctgccttccatttcaacatcctgaagccctatatgaagattttcaatgagagtgtgaacatcatgcacgccaagtggcagctcctggcctcagaggdtagtgcctgtttggatatgtttgagcacatcagcctcatgaccttggacagtctacagaaatgtgtcttcagctttgacagccattgtcaggagaaaccc

SEQ ID NO: 3292 - DNA, 201 bp, Homo sapiens
ggaagaagttatctgatgaggacataagagcagaagctgacacctttatgtttgagggccatgacaccacggccagtggtctctcctgggtcctgtaccaycttgcaaagcacccagaataccaggagcgctgccggcaggaggtgcaagaacttctgaaggaccgtgagcctaaagagattgaatgggacgacctggccc

SEQ ID NO: 3293 - DNA, 201 bp, Homo sapiens
ccgccatgtcacccaggacattgtgctcccagacggccgggtcatccccaaaggcattatctgcctcatcagtgttttcggaacccatcacaacccagctrtgtggccggaccctgaggtctacgacccctttcgctttgacccagagaacatcaaggagaggtcacctctggcttttattcccttctcggcagggcccag

SEQ ID NO: 3294 - DNA, 201 bp, Homo sapiens
cgcagagggcggactttggctgcgggtggagcccctgagctgagttctgcagagacccactctgaccccactaaaatgacccctgattcatcaaaagtgargcctagaattaccctaagaccctgttccacagtcctgtattccatcctagatatctactcaaaataattgagacaagtgttcaaacagaaagacgcttgt

SEQ ID NO: 3295 - DNA, 201 bp, Homo sapiens
acactgtggatgaaccttgaatgcatgatactgaatgaaagacgtcagatgcaaaaggtcacatagtgtactgtccttttatacgaaatttccagaacagrccaatctgaagagatgcatagcggattggtggctttcagcagctgtggggaggtgggactgaggagcgactgctaatcagtatggggtttcctcccggga

SEQ ID NO: 3296 - DNA, 201 bp, Homo sapiens
tcctgctggtcggggcctcctggctcctggcccatgtcctggcctggacctacgccttctatgacaactgccgccgccttcggtgtttcccacaacccccragacggaactggttttggggacaccagggcatggtcaaccccacagaggagggcatgagagttctgactcagctggtggccacctacccccagggcttta

SEQ ID NO: 3297 - DNA, 125 bp, Homo sapiens
cagcagacagagagaggaggttgtytgggacagactgctcctgacagaaggatgtcccagctgagcctgtcctggctgggcctctggccagtggcagcatccccttggctgctcctcctgctggt

SEQ ID NO: 3298 - DNA, 123 bp, Homo sapiens
cagcagacagagagaggaggttrtctgggacagactgctcctgacagaaggatgtcccagctgagcctgtcctggctgggcctctggccagtggcagcatccccttggctgctcctcctgctg

SEQ ID NO: 3299 - DNA, 171 bp, Homo sapiens
cagcagacagagagaggaggttgtctgggacagactgctcctgacagaaggatgtcccagctgagcctgtmctggctgggcctctggccagtggcagcatccccttggctgctcctcctgctggtcggggcctcctggctcctggcccatgtcctggcctggacctacgcc

SEQ ID NO: 3300 - DNA, 201 bp, Homo sapiens; identical to SEQ ID NO: 3282

SEQ ID NO: 3301 - DNA, 185 bp, Homo sapiens; identical to SEQ ID NO: 3283

SEQ ID NO: 3302 - DNA, 187 bp, Homo sapiens; identical to SEQ ID NO: 3284

SEQ ID NO: 3303 - DNA, 201 bp, Homo sapiens; identical to SEQ ID NO: 3285

SEQ ID NO: 3304 - DNA, 189 bp, Homo sapiens; identical to SEQ ID NO: 3287

SEQ ID NO: 3305 - DNA, 201 bp, Homo sapiens
gctccagctgccattgcaccaaaggacaagttcttctacagcttcctggagccctggctgggggatgggctcctgctgagtgctggtgacaagtggagccrccaccgtcggatgctgacgcctgccttccatttcaacatcctgaagccctatatgaagattttcaatgagagtgtgaacatcatgcacgccaagtggcag

SEQ ID NO: 3306 - DNA, 201 bp, Homo sapiens; identical to SEQ ID NO: 3289

SEQ ID NO: 3307 - DNA, 201 bp, Homo sapiens; identical to SEQ ID NO: 3290

SEQ ID NO: 3308 - DNA, 201 bp, Homo sapiens; identical to SEQ ID NO: 3291

SEQ ID NO: 3309 - DNA, 201 bp, Homo sapiens; identical to SEQ ID NO: 3292

SEQ ID NO: 3310 - DNA, 201 bp, Homo sapiens; identical to SEQ ID NO: 3293

SEQ ID NO: 3311 - DNA, 201 bp, Homo sapiens; identical to SEQ ID NO: 3294

SEQ ID NO: 3312 - DNA, 201 bp, Homo sapiens; identical to SEQ ID NO: 3295

SEQ ID NO: 3313 - DNA, 125 bp, Homo sapiens; identical to SEQ ID NO: 3297

SEQ ID NO: 3314 - DNA, 201 bp, Homo sapiens
tcctgctggtcggggcctcctggctcctggcccatgtcctggcctggacctacgccttctatgacaactgccgccgccttcggtgtttcccacaacccccragacggaactggttttggggacaccagggcatgattcacagctcagaagaaggtctcctatacacacaaagcctggcgtgcacctttggggatatgggct

SEQ ID NO: 3315 - DNA, 171 bp, Homo sapiens; identical to SEQ ID NO: 3299

SEQ ID NO: 3316 - DNA, 123 bp, Homo sapiens; identical to SEQ ID NO: 3298

SEQ ID NO: 3317 - DNA, 201 bp, Homo sapiens; identical to SEQ ID NO: 3282

SEQ ID NO: 3318 - DNA, 201 bp, Homo sapiens
ccctggaggtccctgggccgttctctgggcctcaggatctcaccgtccatcccgtctgccctgcaggatgtcccagctgagcctgtcctggctgggcctckggccagtggcagcatccccttggctgctcctcctgctggtcggggcctcctggctcctggcccatgtcctggcctggacctacgccttctatgacaactg

SEQ ID NO: 3319 - DNA, 102 bp, Homo sapiens
cygcccgtccctgcctctccactgtccctggaggtccctgggccgttctctgggcctcaggatctcaccgtccatcccgtctgccctgcaggatgtcccagc

SEQ ID NO: 3320 - DNA, 201 bp, Homo sapiens
ctggaggtccctgggccgttctctgggcctcaggatctcaccgtccatcccgtctgccctgcaggatgtcccagctgagcctgtcctggctgggcctctgsccagtggcagcatccccttggctgctcctcctgctggtcggggcctcctggctcctggcccatgtcctggcctggacctacgccttctatgacaactgcc

SEQ ID NO: 3321 - DNA, 201 bp, Homo sapiens; identical to SEQ ID NO: 3285

SEQ ID NO: 3322 - DNA, 201 bp, Homo sapiens; identical to SEQ ID NO: 3286

SEQ ID NO: 3323 - DNA, 201 bp, Homo sapiens
ggaggtccctgggccgttctctgggcctcaggatctcaccgtccatcccgtctgccctgcaggatgtcccagctgagcctgtcctggctgggcctctggcsagtggcagcatccccttggctgctcctcctgctggtcggggcctcctggctcctggcccatgtcctggcctggacctacgccttctatgacaactgccgc

SEQ ID NO: 3324 - DNA, 201 bp, Homo sapiens; identical to SEQ ID NO: 3288

SEQ ID NO: 3325 - DNA, 180 bp, Homo sapiens
ctgcccgtccctgcctctccactgtccctggaggtccctgggccgttctctgggcctcaggatctcaccgtccatcccgyctgccctgcaggatgtcccagctgagcctgtcctggctgggcctctggccagtggcagcatccccttggctgctcctcctgctggtcggggcctcctggc

SEQ ID NO: 3326 - DNA, 201 bp, Homo sapiens; identical to SEQ ID NO: 3289

SEQ ID NO: 3327 - DNA, 170 bp, Homo sapiens
ctgcccgtccctgcctctccactgtccctggaggtccctgggccgttctctgggcctcaggatctcaccrtccatcccgtctgccctgcaggatgtcccagctgagcctgtcctggctgggcctctggccagtggcagcatccccttggctgctcctcctgctggtcggg

SEQ ID NO: 3328 - DNA, 201 bp, Homo sapiens; identical to SEQ ID NO: 3290

SEQ ID NO: 3329 - DNA, 201 bp, Homo sapiens; identical to SEQ ID NO: 3291

SEQ ID NO: 3330 - DNA, 201 bp, Homo sapiens; identical to SEQ ID NO: 3292

SEQ ID NO: 3331 - DNA, 150 bp, Homo sapiens
ctgcccgtccctgcctctccactgtccctggaggtccctgggccgttctytgggcctcaggatctcaccgtccatcccgtctgccctgcaggatgtcccagctgagcctgtcctggctgggcctctggccagtggcagcatccccttggc

SEQ ID NO: 3332 - DNA, 145 bp, Homo sapiens
ctgcccgtccctgcctctccactgtccctggaggtccctgggccsttctctgggcctcaggatctcaccgtccatcccgtctgccctgcaggatgtcccagctgagcctgtcctggctgggcctctggccagtggcagcatcccc

SEQ ID NO: 3333 - DNA, 201 bp, Homo sapiens; identical to SEQ ID NO: 3293

SEQ ID NO: 3334 - DNA, 201 bp, Homo sapiens; identical to SEQ ID NO: 3294

SEQ ID NO: 3335 - DNA, 116 bp, Homo sapiens
ctgcccgtccctgccyctccactgtccctggaggtccctgggccgttctctgggcctcaggatctcaccgtccatcccgtctgccctgcaggatgtcccagctgagcctgtcctgg

SEQ ID NO: 3336 - DNA, 201 bp, Homo sapiens; identical to SEQ ID NO: 3295

SEQ ID NO: 3337 - DNA, 201 bp, Homo sapiens; identical to SEQ ID NO: 3296

SEQ ID NO: 3338 - DNA, 201 bp, Homo sapiens
tgcctctccactgtccctggaggtccctgggccgttctctgggcctcaggatctcaccgtccatcccgtctgccctgcaggatgtcccagctgagcctgtmctggctgggcctctggccagtggcagcatccccttggctgctcctcctgctggtcggggcctcctggctcctggcccatgtcctggcctggacctacgcc

SEQ ID NO: 3339 - DNA, 201 bp, Homo sapiens
ctatgtggtgctcaccagcgtgaacctcttcattggcattaatggcagcgtggccacctttgtgctggagctgttcaccgacaataagctgaataatatcmatgatatcctgaagtccgtgttcttgatcttcccacatttttgcctgggacgagggctcatcgacatggtgaaaaaccaggcaatggctgatgccctgga

SEQ ID NO: 3340 - DNA, 201 bp, Homo sapiens
gttacgttgatgacatctttctgcgggtgatgagccggtcaatgcccctcttcatgacgctggcctggatttactcagtggctgtgatcatcaagggcatygtgtatgagaaggaggcacggctgaaagagaccatgcggatcatgggcctggacaacagcatcctctggtttagctggttcattagtagcctcattcctc

SEQ ID NO: 3341 - DNA, 201 bp, Homo sapiens
tcgatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccggctctcagacctgggcatttctagttatggcatctcagagacgaccctgg

SEQ ID NO: 3342 - DNA, 201 bp, Homo sapiens
tgcgcaaagttctgagaacattacagcagatcaagaaatccagctcaaacttgaagcttcaagatttcctggtggacaatgaaaccttctctgggttcctrtatcacaacctctctctcccaaagtctactgtggacaagatgctgagggctgatgtcattctccacaaggtatttttgcaaggctaccagttacatttga

SEQ ID NO: 3343 - DNA, 201 bp, Homo sapiens
ctatggggtgatgacctggtacattgaggctgtctttccaggccagtacggaattcccaggccctggtattttccttgcaccaagtcctactggtttggcraggaaagtgatgagaagagccaccctggttccaaccagaagagaatatcagaaatctgcatggaggaggaacccacccacttgaagctgggcgtgtccat

SEQ ID NO: 3344 - DNA, 201 bp, Homo sapiens
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctgagaacactaaactctacatctcccttcccgagcaag

SEQ ID NO: 3345 - DNA, 201 bp, Homo sapiens
agtatcttatcaaacatccatgaagtacatcagaacatgggctactgccctcagtttgatgccatcacagagctgttgactgggagagaacacgtggagtyctttgcccttttgagaggagtcccagagaaagaagttggcaaggttggtgagtgggcgattcggaaactgggcctcgtgaagtatggagaaaaatatgct

SEQ ID NO: 3346 - DNA, 201 bp, Homo sapiens
atggtcaatggaaggttcaggtgccttggcagtgtccagcatctaaaaaataggtttggagatggttatacaatagttgtacgaatagcagggtccaaccyggacctgaagcctgtccaggatttctttggacttgcatttcctggaagtgttctaaaagagaaacaccggaacatgctacaataccagcttccatcttca

SEQ ID NO: 3347 - DNA, 201 bp, Homo sapiens
ccatagcaacagaagtctggctcatcaacaagtccatggagctgctggatgagaggaagttctgggctggtattgtgttcactggaattactccaggcagyattgagctgccccatcatgtcaagtacaagatccgaatggacattgacaatgtggagaggacaaataaaatcaaggatgggtactgggaccctggtcctc

SEQ ID NO: 3348 - DNA, 201 bp, Homo sapiens
tcaaacaaatgaagaaacacctaaagctggccaaggacagttctgcagatcgatttctcaacagcttgggaagatttatgacaggactggacaccagaaayaatgtcaaggtgtggttcaataacaagggctggcatgcaatcagctctttcctgaatgtcatcaacaatgccattctccgggccaacctgcaaaagggag

SEQ ID NO: 3349 - DNA, 201 bp, Homo sapiens
atgctcctgaggacacgggaaccctggaactcttaaacgccctcaccaaagaccctggcttcgggacccgctgtatggaaggaaacccaatcccagacacrccctgccaggcaggggaggaagagtggaccactgccccagttccccagaccatcatggacctcttccagaatgggaactggacaatgcagaacccttcac

SEQ ID NO: 3350 - DNA, 201 bp, Homo sapiens
aagctgggcgtgtccattcagaacctggtaaaagtctaccgagatgggatgaaggtggctgtcgatggcctggcactgaatttttatgagggccagatcayctccttcctgggccacaatggagcggggaagacgaccaccatgtcaatcctgaccgggttgttccccccgacctcgggcaccgcctacatcctgggaaaa

SEQ ID NO: 3351 - DNA, 201 bp, Homo sapiens
ccctggttccaaccagaagagaatatcagaaatctgcatggaggaggaacccacccacttgaagctgggcgtgtccattcagaacctggtaaaagtctacygagatgggatgaaggtggctgtcgatggcctggcactgaatttttatgagggccagatcacctccttcctgggccacaatggagcggggaagacgaccac

SEQ ID NO: 3352 - DNA, 201 bp, Homo sapiens
gaagatcctgtatacacctgacactccagccacaaggcaggtcatggctgaggtgaacaagaccttccaggaactggctgtgttccatgatctggaaggcmtgtgggaggaactcagccccaagatctggaccttcatggagaacagccaagaaatggaccttgtccggatgctgttggacagcagggacaatgaccactt

SEQ ID NO: 3353 - DNA, 201 bp, Homo sapiens
ctccagagccaacctggcagcagcctgtgggggcatcatctacttcacgctgtacctgccctacgtcctgtgtgtggcatggcaggactacgtgggcttcmcactcaagatcttcgctagcctgctgtctcctgtggcttttgggtttggctgtgagtactttgccctttttgaggagcagggcattggagtgcagtggga

SEQ ID NO: 3354 - DNA, 201 bp, Homo sapiens
cctacttgcaggatgtggtggagcaggcaatcatcagggtgctgacgggcaccgagaagaaaactggtgtctatatgcaacagatgccctatccctgttasgttgatgacatctttctgcgggtgatgagccggtcaatgcccctcttcatgacgctggcctggatttactcagtggctgtgatcatcaagggcatcgtgt

SEQ ID NO: 3355 - DNA, 201 bp, Homo sapiens
gagaggacaaataaaatcaaggatgggtactgggaccctggtcctcgagctgacccctttgaggacatgcggtacgtctgggggggcttcgcctacttgcrggatgtggtggagcaggcaatcatcagggtgctgacgggcaccgagaagaaaactggtgtctatatgcaacagatgccctatccctgttacgttgatgac

SEQ ID NO: 3356 - DNA, 201 bp, Homo sapiens
cgaatggacattgacaatgtggagaggacaaataaaatcaaggatgggtactgggaccctggtcctcgagctgacccctttgaggacatgcggtacgtctbggggggcttcgcctacttgcaggatgtggtggagcaggcaatcatcagggtgctgacgggcaccgagaagaaaactggtgtctatatgcaacagatgccc

SEQ ID NO: 3357 - DNA, 201 bp, Homo sapiens
agggctcatcgacatggtgaaaaaccaggcaatggctgatgccctggaaaggtttggggagaatcgctttgtgtcaccattatcttgggacttggtgggaygaaacctcttcgccatggccgtggaaggggtggtgttcttcctcattactgttctgatccagtacagattcttcatcaggcccagacctgtaaatgcaaa

SEQ ID NO: 3358 - DNA, 201 bp, Homo sapiens
ccggcagaacctgggggtctgtccccagcataacgtgctgtttgacatgctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtggaatgca

SEQ ID NO: 3359 - DNA, 201 bp, Homo sapiens
cacactcttctccagagccaacctggcagcagcctgtgggggcatcatctacttcacgctgtacctgccctacgtcctgtgtgtggcatggcaggactacrtgggcttcacactcaagatcttcgctagcctgctgtctcctgtggcttttgggtttggctgtgagtactttgccctttttgaggagcagggcattggagt

SEQ ID NO: 3360 - DNA, 102 bp, Homo sapiens
gyaattgcgagcgagagtgagtggggccgggacccgcagagccgagccgacccttctctcccgggctgcggcagggcagggcggggagctccgcgcaccaac

SEQ ID NO: 3361 - DNA, 201 bp, Homo sapiens
tgaatgatgaagatgaagatgtgaggcgggaaagacagagaattcttgatggtggaggccagaatgacatcttagaaatcaaggagttgacgaagatatayagaaggaagcggaagcctgctgttgacaggatttgcgtgggcattcctcctggtgagtgctttgggctcctgggagttaatggggctggaaaatcatcaa

SEQ ID NO: 3362 - DNA, 201 bp, Homo sapiens
acaccacatggatgaagcggacgtcctgggggacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaagga

SEQ ID NO: 3363 - DNA, 201 bp, Homo sapiens
gggaagatttatgacaggactggacaccagaaataatgtcaaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctc

SEQ ID NO: 3364 - DNA, 201 bp, Homo sapiens
acctcttccagaatgggaactggacaatgcagaacccttcacctgcatgccagtgtagcagcgacaaaatcaagaagatgctgcctgtgtgtcccccaggkgcaggggggctgcctcctccacaaagaaaacaaaacactgcagatatccttcaggacctgacaggaagaaacatttcggattatctggtgaagacgtatg

SEQ ID NO: 3365 - DNA, 201 bp, Homo sapiens
gtaatggttctgtgtacacctggagagaagctttcaacgagactaaccaggcaatccggaccatatctcgcttcatggagtgtgtcaacctgaacaagctrgaacccatagcaacagaagtctggctcatcaacaagtccatggagctgctggatgagaggaagttctgggctggtattgtgttcactggaattactccag

SEQ ID NO: 3366 - DNA, 201 bp, Homo sapiens
taaaagtctaccgagatgggatgaaggtggctgtcgatggcctggcactgaatttttatgagggccagatcacctccttcctgggccacaatggagcgggraagacgaccaccatgtcaatcctgaccgggttgttccccccgacctcgggcaccgcctacatcctgggaaaagacattcgctctgagatgagcaccatcc

SEQ ID NO: 3367 - DNA, 201 bp, Homo sapiens
gtttgccatcaagcaagctgaaaagcaaaacaagccagctgtcaggtggaatgcagagaaagctatctgtggccttggcctttgtcgggggatctaaggtkgtcattctggatgaacccacagctggtgtggacccttactcccgcaggggaatatgggagctgctgctgaaataccgacaaggccgcaccattattctct

SEQ ID NO: 3368 - DNA, 201 bp, Homo sapiens
aggtggctctgatgaccacatcagtggatgtccttgtgtccatctgtgtcatctttgcaatgtccttcgtcccagccagctttgtcgtattcctgatccargagcgggtcagcaaagcaaaacacctgcagttcatcagtggagtgaagcctgtcatctactggctctctaattttgtctgggatatgtgcaattacgttg

SEQ ID NO: 3369 - DNA, 201 bp, Homo sapiens
tgttcaagatccccagcacagcctatgtggtgctcaccagcgtgaacctcttcattggcattaatggcagcgtggccacctttgtgctggagctgttcacygacaataagctgaataatatcaatgatatcctgaagtccgtgttcttgatcttcccacatttttgcctgggacgagggctcatcgacatggtgaaaaacc

SEQ ID NO: 3370 - DNA, 201 bp, Homo sapiens
actggctgcagcagagcgagtacttcgttccaacatggacatcctgaagccaatcctgagaacactaaactctacatctcccttcccgagcaaggagctgrctgaagccacaaaaacattgctgcatagtcttgggactctggcccaggagctgttcagcatgagaagctggagtgacatgcgacaggaggtgatgtttct

SEQ ID NO: 3371 - DNA, 201 bp, Homo sapiens
tggatcaaaatcagaagagatgattcaacttggtgaccaagaagtttctgagctttgtggcctaccaagggagaaactggctgcagcagagcgagtacttygttccaacatggacatcctgaagccaatcctgagaacactaaactctacatctcccttcccgagcaaggagctggctgaagccacaaaaacattgctgca

SEQ ID NO: 3372 - DNA, 201 bp, Homo sapiens
tgaggagcagggcattggagtgcagtgggacaacctgtttgagagtcctgtggaggaagatggcttcaatctcaccacttcggtctccatgatgctgtttracaccttcctctatggggtgatgacctggtacattgaggctgtctttccaggccagtacggaattcccaggccctggtattttccttgcaccaagtccta

SEQ ID NO: 3373 - DNA, 201 bp, Homo sapiens
ttctgcgggtgatgagccggtcaatgcccctcttcatgacgctggcctggatttactcagtggctgtgatcatcaagggcatcgtgtatgagaaggaggcrcggctgaaagagaccatgcggatcatgggcctggacaacagcatcctctggtttagctggttcattagtagcctcattcctcttcttgtgagcgctggcc

SEQ ID NO: 3374 - DNA, 201 bp, Homo sapiens
gccatcaaacaaatgaagaaacacctaaagctggccaaggacagttctgcagatcgatttctcaacagcttgggaagatttatgacaggactggacaccaraaataatgtcaaggtgtggttcaataacaagggctggcatgcaatcagctctttcctgaatgtcatcaacaatgccattctccgggccaacctgcaaaag

SEQ ID NO: 3375 - DNA, 201 bp, Homo sapiens
tcagttcctgcagaaacagtagtagcactgtgtcatacctgaaaaaggaggacagtgtttctcagagcagttctgatgctggcctgggcagcgaccatgasagtgacacgctgaccatcgatgtctctgctatctccaacctcatcaggaagcatgtgtctgaagcccggctggtggaagacatagggcatgagctgacct

SEQ ID NO: 3376 - DNA, 201 bp, Homo sapiens
cctggatttactcagtggctgtgatcatcaagggcatcgtgtatgagaaggaggcacggctgaaagagaccatgcggatcatgggcctggacaacagcatmctctggtttagctggttcattagtagcctcattcctcttcttgtgagcgctggcctgctagtggtcatcctgaagttaggaaacctgctgccctacagtg

SEQ ID NO: 3377 - DNA, 201 bp, Homo sapiens
aggaggtgatgtttctgaccaatgtgaacagctccagctcctccacccaaatctaccaggctgtgtctcgtattgtctgcgggcatcccgagggagggggrctgaagatcaagtctctcaactggtatgaggacaacaactacaaagccctctttggaggcaatggcactgaggaagatgctgaaaccttctatgacaact

SEQ ID NO: 3378 - DNA, 201 bp, Homo sapiens
ggctggtggaagacatagggcatgagctgacctatgtgctgccatatgaagctgctaaggagggagcctttgtggaactctttcatgagattgatgaccgrctctcagacctgggcatttctagttatggcatctcagagacgaccctggaagaaatattcctcaaggtggccgaagagagtggggtggatgctgagacct

SEQ ID NO: 3379 - DNA, 201 bp, Homo sapiens
tatagtaaatctatgagcaactccttacttcggttcctctgatttcaaggccatattttaaaaaatcaaaaggcactgtgaactattttgaagaaaacacracattttaatacagattgaaaggacctcttctgaagctagaaacaatctatagttatacatcttcattaatactgtgttaccttttaaaatagtaatttt

SEQ ID NO: 3380 - DNA, 201 bp, Homo sapiens
gtgacatgcgacaggaggtgatgtttctgaccaatgtgaacagctccagctcctccacccaaatctaccaggctgtgtctcgtattgtctgcgggcatccygagggaggggggctgaagatcaagtctctcaactggtatgaggacaacaactacaaagccctctttggaggcaatggcactgaggaagatgctgaaacct

SEQ ID NO: 3381 - DNA, 201 bp, Homo sapiens
gggctcatcgacatggtgaaaaaccaggcaatggctgatgccctggaaaggtttggggagaatcgctttgtgtcaccattatcttgggacttggtgggacraaacctcttcgccatggccgtggaaggggtggtgttcttcctcattactgttctgatccagtacagattcttcatcaggcccagacctgtaaatgcaaag

SEQ ID NO: 3382 - DNA, 201 bp, Homo sapiens
catgaatgccattttccaaataaagccatgccctctgcaggaacacttccttgggttcaggggattatctgtaatgccaacaacccctgtttccgttaccygactcctggggaggctcccggagttgttggaaactttaacaaatccattgtggctcgcctgttctcagatgctcggaggcttcttttatacagccagaaa

SEQ ID NO: 3383 - DNA, 201 bp, Homo sapiens
agaaaagaaaaatatgagagaactattgtttggggaagttcaagtgatctttcaatatcattactaacttcttccactttttccagaatttgaatattaaygctaaaggtgtaagacttcagatttcaaattaatctttctatattttttaaatttacagaatattatataacccactgctgaaaaagaaaaaaatgattg

SEQ ID NO: 3384 - DNA, 201 bp, Homo sapiens
tgtggacccttactcccgcaggggaatatgggagctgctgctgaaataccgacaaggccgcaccattattctctctacacaccacatggatgaagcggacrtcctgggggacaggattgccatcatctcccatgggaagctgtgctgtgtgggctcctccctgtttctgaagaaccagctgggaacaggctactacctgac

SEQ ID NO: 3385 - DNA, 201 bp, Homo sapiens
gccctcattccaagcactttacgctgtctgtaatgggatctatttttgcactggaatatctgagaattgcaaaactagacaaaagtttcacaacagatttytaagttaaatcattttcattaaaaggaaaaaagaaaaaaaattttgtatgtcaataactttatatgaagtattaaaatgcatatttctatgttgtaatat

SEQ ID NO: 3386 - DNA, 201 bp, Homo sapiens
tttgccatcaagcaagctgaaaagcaaaacaagccagctgtcaggtggaatgcagagaaagctatctgtggccttggcctttgtcgggggatctaaggttrtcattctggatgaacccacagctggtgtggacccttactcccgcaggggaatatgggagctgctgctgaaataccgacaaggccgcaccattattctctc

SEQ ID NO: 3387 - DNA, 201 bp, Homo sapiens
ttcgcccgttcactgaagatgatgctgctgatccaaatgattctgacatagacccagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttg

SEQ ID NO: 3388 - DNA, 201 bp, Homo sapiens
gacgcaaacacaaaagtggaaaacagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacatgtcagctgctgctgga

SEQ ID NO: 3389 - DNA, 201 bp, Homo sapiens
tggtcaatggaaggttcaggtgccttggcagtgtccagcatctaaaaaataggtttggagatggttatacaatagttgtacgaatagcagggtccaacccrgacctgaagcctgtccaggatttctttggacttgcatttcctggaagtgttctaaaagagaaacaccggaacatgctacaataccagcttccatcttcat

SEQ ID NO: 3390 - DNA, 201 bp, Homo sapiens
gttaactgtcttgagagaaaagaaaaatatgagagaactattgtttggggaagttcaagtgatctttcaatatcattactaacttcttccactttttccaraatttgaatattaacgctaaaggtgtaagacttcagatttcaaattaatctttctatattttttaaatttacagaatattatataacccactgctgaaaa

SEQ ID NO: 3391 - DNA, 201 bp, Homo sapiens
tgcaaggctaccagttacatttgacaagtctgtgcaatggatcaaaatcagaagagatgattcaacttggtgaccaagaagtttctgagctttgtggcctrccaagggagaaactggctgcagcagagcgagtacttcgttccaacatggacatcctgaagccaatcctgagaacactaaactctacatctcccttcccga

SEQ ID NO: 3392 - DNA, 201 bp, Homo sapiens
agctttgtcgtattcctgatccaggagcgggtcagcaaagcaaaacacctgcagttcatcagtggagtgaagcctgtcatctactggctctctaattttgwctgggatatgtgcaattacgttgtccctgccacactggtcattatcatcttcatctgcttccagcagaagtcctatgtgtcctccaccaatctgcctgtg

SEQ ID NO: 3393 - DNA, 201 bp, Homo sapiens
tgagtactttgccctttttgaggagcagggcattggagtgcagtgggacaacctgtttgagagtcctgtggaggaagatggcttcaatctcaccacttcgrtctccatgatgctgtttgacaccttcctctatggggtgatgacctggtacattgaggctgtctttccaggccagtacggaattcccaggccctggtattt

SEQ ID NO: 3394 - DNA, 201 bp, Homo sapiens
aggattttttgctcagattgtcttgccagctgtgtttgtctgcattgcccttgtgttcagcctgatcgtgccaccctttggcaagtaccccagcctggaayttcagccctggatgtacaacgaacagtacacatttgtcagcaatgatgctcctgaggacacgggaaccctggaactcttaaacgccctcaccaaagaccc

SEQ ID NO: 3395 - DNA, 201 bp, Homo sapiens
acggaattcccaggccctggtattttccttgcaccaagtcctactggtttggcgaggaaagtgatgagaagagccaccctggttccaaccagaagagaatrtcagaaatctgcatggaggaggaacccacccacttgaagctgggcgtgtccattcagaacctggtaaaagtctaccgagatgggatgaaggtggctgtcg

SEQ ID NO: 3396 - DNA, 187 bp, Homo sapiens
aatatctgagaattgcaaaactagacaaaagtttcacaacagatttctaagttaaatcattttcattaaaaggaaaaaagaaaaaaaattttgtatgtcartaactttatatgaagtattaaaatgcatatttctatgttgtaatataatgagtcacaaaataaagctgtgacagttctgttggtct

SEQ ID NO: 3397 - DNA, 201 bp, Homo sapiens
cgattcggaaactgggcctcgtgaagtatggagaaaaatatgctggtaactatagtggaggcaacaaacgcaagctctctacagccatggctttgatcggygggcctcctgtggtgtttctggatgaacccaccacaggcatggatcccaaagcccggcggttcttgtggaattgtgccctaagtgttgtcaaggagggga

SEQ ID NO: 3398 - DNA, 201 bp, Homo sapiens
gagatattaagtctcagtacacttcctgtgccatgttattcagctcactggtttacaaatataggttgtcttgtggttgtaggagcccactgtaacaataytgggcagcctttttttttttttttttaattgcaacaatgcaaaagccaagaaagtataagggtcacaagtctaaacaatgaattcttcaacagggaaaac

SEQ ID NO: 3399 - DNA, 201 bp, Homo sapiens
agttgacagaatggtgccatgcgtggctaacatcctgctttgattccctctgataagctgttctggtggcagtaacatgcaacaaaaatgtgggtgtctcyaggcacgggaaacttggttccattgttatattgtcctatgcttcgagccatgggtctacagggtcatccttatgagactcttaaatatacttagatcctg

SEQ ID NO: 3400 - DNA, 201 bp, Homo sapiens
ttatggaacccaatggacatatgggtttgaactcacacttttttttttttttttgttcctgtgtattctcattggggttgcaacaataattcatcaagtartcatggccagcgattattgatcaaaatcaaaaggtaatgcacatcctcattcactaagccatgccatgcccaggagactggtttcccggtgacacatcca

SEQ ID NO: 3401 - DNA, 201 bp, Homo sapiens
ttactcccgcaggggaatatgggagctgctgctgaaataccgacaaggccgcaccattattctctctacacaccacatggatgaagcggacgtcctggggkacaggattgccatcatctcccatgggaagctgtgctgtgtgggctcctccctgtttctgaagaaccagctgggaacaggctactacctgaccttggtcaa

SEQ ID NO: 3402 - DNA, 201 bp, Homo sapiens
tttatgagggccagatcacctccttcctgggccacaatggagcggggaagacgaccaccatgtcaatcctgaccgggttgttccccccgacctcgggcacygcctacatcctgggaaaagacattcgctctgagatgagcaccatccggcagaacctgggggtctgtccccagcataacgtgctgtttgacatgctgactg

SEQ ID NO: 3403 - DNA, 201 bp, Homo sapiens
cgggccaacctgcaaaagggagagaaccctagccattatggaattactgctttcaatcatcccctgaatctcaccaagcagcagctctcagaggtggctcygatgaccacatcagtggatgtccttgtgtccatctgtgtcatctttgcaatgtccttcgtcccagccagctttgtcgtattcctgatccaggagcgggtc

SEQ ID NO: 3404 - DNA, 201 bp, Homo sapiens
cctctttcccgcattatctggaaagctctgaagccgctgctcgttgggaagatcctgtatacacctgacactccagccacaaggcaggtcatggctgaggygaacaagaccttccaggaactggctgtgttccatgatctggaaggcatgtgggaggaactcagccccaagatctggaccttcatggagaacagccaagaa

SEQ ID NO: 3405 - DNA, 201 bp, Homo sapiens
agacaacacttgaccaagtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaacta

SEQ ID NO: 3406 - DNA, 201 bp, Homo sapiens
catagcaacagaagtctggctcatcaacaagtccatggagctgctggatgagaggaagttctgggctggtattgtgttcactggaattactccaggcagcrttgagctgccccatcatgtcaagtacaagatccgaatggacattgacaatgtggagaggacaaataaaatcaaggatgggtactgggaccctggtcctcg

SEQ ID NO: 3407 - DNA, 201 bp, Homo sapiens
aagaacaagatctgggtgaatgagtttaggtatggcggcttttccctgggtgtcagtaatactcaagcacttcctccgagtcaagaagttaatgatgccaycaaacaaatgaagaaacacctaaagctggccaaggacagttctgcagatcgatttctcaacagcttgggaagatttatgacaggactggacaccagaaat

SEQ ID NO: 3408 - DNA, 201 bp, Homo sapiens
ctggtaaaagtctaccgagatgggatgaaggtggctgtcgatggcctggcactgaatttttatgagggccagatcacctccttcctgggccacaatggagyggggaagacgaccaccatgtcaatcctgaccgggttgttccccccgacctcgggcaccgcctacatcctgggaaaagacattcgctctgagatgagcacc

SEQ ID NO: 3409 - DNA, 102 bp, Homo sapiens; identical to SEQ ID NO: 3360

SEQ ID NO: 3410 - DNA, 201 bp, Homo sapiens; identical to SEQ ID NO: 3382

SEQ ID NO: 3411 - DNA, 201 bp, Homo sapiens; identical to SEQ ID NO: 3388

SEQ ID NO: 3412 - DNA, 201 bp, Homo sapiens
atactggtgagcctgagcagtttggtcatcagagtgttttatatagttccagaacaaatatgtctctaggtgttctgagagctctggtgaaattcctctcsctaccccaaacatcatcatttaatatccaggattctggttttctactcaccagatagattctcttaaaaccagggaaagattcctggaggaaggatgtat

SEQ ID NO: 3413 - DNA, 201 bp, Homo sapiens
agatgacattgtgggctgtcacagttggaaggccctggaattagatgagaccacactatttagcttacttagtaataacattgcaaagaaaaattccgacraagttttttcagcctaggaatcaatagttcagagaagcactctatgagaatacccattcattcttaaccaaaaaatactggtgagcctgagcagtttggt

SEQ ID NO: 3414 - DNA, 201 bp, Homo sapiens
aacagagttcttcatatttaaaaaaaaaaagtcttgaaaccattgatgggaagatggatatctatttatgtttaaaaacccatcataaagatgacattgtrggctgtcacagttggaaggccctggaattagatgagaccacactatttagcttacttagtaataacattgcaaagaaaaattccgacgaagttttttcag

SEQ ID NO: 3415 - DNA, 201 bp, Homo sapiens; identical to SEQ ID NO: 3342

SEQ ID NO: 3416 - DNA, 201 bp, Homo sapiens
aagaagtttctgagctttgtggcctaccaagggagaaactggctgcagcagagcgagtacttcgttccaacatggacatcctgaagccaatcctggtgagyagacttgctcactggagaaacttcaagcactaatgctttcggaatgtgaggcttttccttggacagcatgactttgttttgtagaaaagtacggctggct

SEQ ID NO: 3417 - DNA, 201 bp, Homo sapiens
tggatcaaaatcagaagagatgattcaacttggtgaccaagaagtttctgagctttgtggcctaccaagggagaaactggctgcagcagagcgagtacttygttccaacatggacatcctgaagccaatcctggtgagtagacttgctcactggagaaacttcaagcactaatgctttcggaatgtgaggcttttccttgg

SEQ ID NO: 3418 - DNA, 201 bp, Homo sapiens
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctggtgagtagacttgctcactggagaaacttcaagcac

SEQ ID NO: 3419 - DNA, 201 bp, Homo sapiens
tgcaaggctaccagttacatttgacaagtctgtgcaatggatcaaaatcagaagagatgattcaacttggtgaccaagaagtttctgagctttgtggcctrccaagggagaaactggctgcagcagagcgagtacttcgttccaacatggacatcctgaagccaatcctggtgagtagacttgctcactggagaaacttca

SEQ ID NO: 3420 - DNA, 124 bp, Homo sapiens
tatccaggattctggttttctactcaccagatagattctcttaaaaccagggaaagattcctggaggaaggatgtatctggaaagagatgttccttattayaataaaatgaaattgtaatactc

SEQ ID NO: 3421 - DNA, 116 bp, Homo sapiens
attctggttttctactcaccagatagattctcttaaaaccagggaaagattcctggaggaaggatgtatctggaaagagatgttccttattataataaaaygaaattgtaatactc

SEQ ID NO: 3422 - DNA, 201 bp, Homo sapiens
ggatatctatttatgtttaaaaacccatcataaagatgacattgtgggctgtcacagttggaaggccctggaattagatgagaccacactatttagcttayttagtaataacattgcaaagaaaaattccgacgaagttttttcagcctaggaatcaatagttcagagaagcactctatgagaatacccattcattcttaa

SEQ ID NO: 3423 - DNA, 201 bp, Homo sapiens; identical to SEQ ID NO: 3342

SEQ ID NO: 3424 - DNA, 201 bp, Homo sapiens
tggatcaaaatcagaagagatgattcaacttggtgaccaagaagtttctgagctttgtggcctaccaagggagaaactggctgcagcagagcgagtacttygttccaacatggacatcctgaagccaatcctgatggatgtgacatgtgatgacattgcacatgggcagttaactgtgccaagaagtgcagcagtagcagc

SEQ ID NO: 3425 - DNA, 201 bp, Homo sapiens
ggctaccagttacatttgacaagtctgtgcaatggatcaaaatcagaagagatgattcaacttggtgaccaagaagtttctgagctttgtggcctaccaarggagaaactggctgcagcagagcgagtacttcgttccaacatggacatcctgaagccaatcctgatggatgtgacatgtgatgacattgcacatgggcag

SEQ ID NO: 3426 - DNA, 201 bp, Homo sapiens
tgcaaggctaccagttacatttgacaagtctgtgcaatggatcaaaatcagaagagatgattcaacttggtgaccaagaagtttctgagctttgtggcctrccaagggagaaactggctgcagcagagcgagtacttcgttccaacatggacatcctgaagccaatcctgatggatgtgacatgtgatgacattgcacatg

SEQ ID NO: 3427 - DNA, 102 bp, Homo sapiens; identical to SEQ ID NO: 3360

SEQ ID NO: 3428 - DNA, 201 bp, Homo sapiens; identical to SEQ ID NO: 3382

SEQ ID NO: 3429 - DNA, 201 bp, Homo sapiens; identical to SEQ ID NO: 3388

SEQ ID NO: 3430 - DNA, 201 bp, Homo sapiens
tgctggcatccctggacttggagttggtgtcggcgtccctggacttggagttggtgctggtgttcctggacttggagttggtgctggtgttcctggcttcbgggcagtacctggagccctggctgccgctaaagcagccaaatatggagcagcagtgcctggggtccttggagggctcggggctctcggtggagtaggcat

SEQ ID NO: 3431 - DNA, 201 bp, Homo sapiens
tccctggtgttggaggggctggtgttcctggcgtgcctggggcaattcctggaattggaggcatcgcaggcgttgggactccagctgcagctgcagctgcrgcagcagccgctaaggcagccaagtatggagctgctgcaggcttagtgcctggtgggccaggctttggcccgggagtagttggtgtcccaggagctggcg

SEQ ID NO: 3432 - DNA, 201 bp, Homo sapiens
tgtggtgggagccggacccgccgccgccgctgccgcagccaaagctgctgccaaagccgcccagtttggcctagtgggagccgctgggctcggaggactcrgagtcggagggcttggagttccaggtgttgggggccttggaggtatacctccagctgcagccgctaaagcagctaaatacggtgctgctggccttggagg

SEQ ID NO: 3433 - DNA, 201 bp, Homo sapiens
gagttggtggcttaggagtgtctgcaggtgcggtggttcctcagcctggagccggagtgaagcctgggaaagtgccgggtgtggggctgccaggtgtatavccaggtggcgtgctcccaggagctcggttccccggtgtgggggtgctccctggagttcccactggagcaggagttaagcccaaggctccaggagttggac

SEQ ID NO: 3434 - DNA, 201 bp, Homo sapiens
gggtgtggggctgccaggtgtatacccaggtggcgtgctcccaggagctcggttccccggtgtgggggtgctccctggagttcccactggagcaggagttwagcccaaggctccaggagttggaccctttgggggaccgcaacctggagtcccactggggtatcccatcaaggcccccaagctgcctggtggctatggact

SEQ ID NO: 3435 - DNA, 201 bp, Homo sapiens
gctggcatccctggacttggagttggtgtcggcgtccctggacttggagttggtgctggtgttcctggacttggagttggtgctggtgttcctggcttcgrggcagtacctggagccctggctgccgctaaagcagccaaatatggagcagcagtgcctggggtccttggagggctcggggctctcggtggagtaggcatc

SEQ ID NO: 3436 - DNA, 201 bp, Homo sapiens
gggctctggtgcctggtggagtggctgacgctgctgcagcctataaagctgctaaggctggcgctgggcttggtggtgtcccaggagttggtggcttaggrgtgtctgcaggtgcggtggttcctcagcctggagccggagtgaagcctgggaaagtgccgggtgtggggctgccaggtgtatacccaggtggcgtgctcc

SEQ ID NO: 3437 - DNA, 201 bp, Homo sapiens
gcctggagccggagtgaagcctgggaaagtgccgggtgtggggctgccaggtgtatacccaggtggcgtgctcccaggagctcggttccccggtgtggggktgctccctggagttcccactggagcaggagttaagcccaaggctccaggagttggaccctttgggggaccgcaacctggagtcccactggggtatcccat

SEQ ID NO: 3438 - DNA, 114 bp, Homo sapiens
aaacattttaatcactctaatataactctggatgaaacacacctttttttttaataagaaaagagaattaactgcttcagaaatgactaataaatgaaaarcctttaaaggaaa

SEQ ID NO: 3439 - DNA, 201 bp, Homo sapiens
ggaggtgtcccgggagttggcatttcccccgaagctcaggcagcagctgccgccaaggctgccaagtacggagtggggaccccagcagctgcagctgctaragcagccgccaaagccgcccagtttgggttagttcctggtgtcggcgtggctcctggagttggcgtggctcctggtgtcggtgtggctcctggagttggc

SEQ ID NO: 3440 - DNA, 201 bp, Homo sapiens
tggtgtggctcctggcgttggcgtggctcccggcattggccctggtggagttgcagctgcagcaaaatccgctgccaaggtggctgccaaagcccagctcygagctgcagctgggcttggtgctggcatccctggacttggagttggtgtcggcgtccctggacttggagttggtgctggtgttcctggacttggagttgg

SEQ ID NO: 3441 - DNA, 201 bp, Homo sapiens
aaagttcggtgctggagcagccggagtcctccctggtgttggaggggctggtgttcctggcgtgcctggggcaattcctggaattggaggcatcgcaggcrttgggactccagctgcagctgcagctgcagcagcagccgctaaggcagccaagtatggagctgctgcaggcttagtgcctggtgggccaggctttggccc

SEQ ID NO: 3442 - DNA, 201 bp, Homo sapiens
gagttggaggcattcctacttacggggttggagctgggggctttcccggctttggtgtcggagtcggaggtatccctggagtcgcaggtgtccctggtgtyggaggtgttcccggagtcggaggtgtcccgggagttggcatttcccccgaagctcaggcagcagctgccgccaaggctgccaagtacggagtggggaccc

SEQ ID NO: 3443 - DNA, 201 bp, Homo sapiens
tcggtgtggctcctggagttggcttggctcctggagttggcgtggctcctggagttggtgtggctcctggcgttggcgtggctcccggcattggccctggwggagttgcagctgcagcaaaatccgctgccaaggtggctgccaaagcccagctccgagctgcagctgggcttggtgctggcatccctggacttggagttg

SEQ ID NO: 3444 - DNA, 201 bp, Homo sapiens
gtaggcatcccaggcggtgtggtgggagccggacccgccgccgccgctgccgcagccaaagctgctgccaaagccgcccagtttggcctagtgggagccgmtgggctcggaggactcggagtcggagggcttggagttccaggtgttgggggccttggaggtatacctccagctgcagccgctaaagcagctaaatacggt

SEQ ID NO: 3445 - DNA, 201 bp, Homo sapiens
cccacatctggggcgcttttgggttggaaaaccaccccacactgggaatagccaccttgcccttgtagaatccatccgcccatccgtccattcatccatcsgtccgtccatccatgtccccagttgaccgcccggcaccactagctggctgggtgcacccaccatcaacctggttgacctgtcatggccgcctgtgccctg

SEQ ID NO: 3446 - DNA, 201 bp, Homo sapiens
aggaaacaagaggggagcggccaagtgccccgaccaggaggccccctacttcagaggcaagggccatgtggtcctggccccccaccccatcccttcccacmtaggagctccccctccacacagcctccatctccaggggaacttggtgctacacgctggtgctcttatcttcctggggggagggaggagggaagggtggcc

SEQ ID NO: 3447 - DNA, 201 bp, Homo sapiens
ttggaggagtggcagcaagacctggcttcggattgtctcccattttcccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccacc

SEQ ID NO: 3448 - DNA, 201 bp, Homo sapiens
ctctctccctccctctttccctcacagccgacgaggcaacaattaggctttggggataaaacgaggtgcggagagcgggctggggcatttctccccgagarggcgggtctgacggcggcggccccgcggcccggagtcctcctgctcctgctgtccatcctccacccctctcggcctggaggggtccctggggccattcct

SEQ ID NO: 3449 - DNA, 201 bp, Homo sapiens
agtcggagttggaggcattcctacttacggggttggagctgggggctttcccggctttggtgtcggagtcggaggtatccctggagtcgcaggtgtccctrgtgtcggaggtgttcccggagtcggaggtgtcccgggagttggcatttcccccgaagctcaggcagcagctgccgccaaggctgccaagtacggagtggg

SEQ ID NO: 3450 - DNA, 201 bp, Homo sapiens
caggtggcgtgctcccaggagctcggttccccggtgtgggggtgctccctggagttcccactggagcaggagttaagcccaaggctccaggagttggaccytttgggggaccgcaacctggagtcccactggggtatcccatcaaggcccccaagctgcctggtggctatggactgccctacaccacagggaaactgccct

SEQ ID NO: 3451 - DNA, 201 bp, Homo sapiens
tgctggcatccctggacttggagttggtgtcggcgtccctggacttggagttggtgctggtgttcctggacttggagttggtgctggtgttcctggcttcbgggcaggtgcagatgagggagttaggcggagcctgtcccctgagctcagggaaggagatccctcctcctctcagcacctccccagcaccccctcatcacc

SEQ ID NO: 3452 - DNA, 201 bp, Homo sapiens; identical to SEQ ID NO: 3431

SEQ ID NO: 3453 - DNA, 201 bp, Homo sapiens; identical to SEQ ID NO: 3432

SEQ ID NO: 3454 - DNA, 201 bp, Homo sapiens
gagttggtggcttaggagtgtctgcaggtgcggtggttcctcagcctggagccggagtgaagcctgggaaagtgccgggtgtggggctgccaggtgtatavccaggtggcgtgctcccaggagctcggttccccggtgtgggggtgctccctggagttcccactggagcaggagttaagcccaaggctccaggtgtaggtg

SEQ ID NO: 3455 - DNA, 201 bp, Homo sapiens
gggtgtggggctgccaggtgtatacccaggtggcgtgctcccaggagctcggttccccggtgtgggggtgctccctggagttcccactggagcaggagttwagcccaaggctccaggtgtaggtggagcttttgctggaatcccaggagttggaccctttgggggaccgcaacctggagtcccactggggtatcccatcaa

SEQ ID NO: 3456 - DNA, 201 bp, Homo sapiens
gctggcatccctggacttggagttggtgtcggcgtccctggacttggagttggtgctggtgttcctggacttggagttggtgctggtgttcctggcttcgrggcaggtgcagatgagggagttaggcggagcctgtcccctgagctcagggaaggagatccctcctcctctcagcacctccccagcaccccctcatcaccc

SEQ ID NO: 3457 - DNA, 201 bp, Homo sapiens; identical to SEQ ID NO: 3436

SEQ ID NO: 3458 - DNA, 201 bp, Homo sapiens
gcctggagccggagtgaagcctgggaaagtgccgggtgtggggctgccaggtgtatacccaggtggcgtgctcccaggagctcggttccccggtgtggggktgctccctggagttcccactggagcaggagttaagcccaaggctccaggtgtaggtggagcttttgctggaatcccaggagttggaccctttgggggacc

SEQ ID NO: 3459 - DNA, 114 bp, Homo sapiens; identical to SEQ ID NO: 3438

SEQ ID NO: 3460 - DNA, 201 bp, Homo sapiens; identical to SEQ ID NO: 3439

SEQ ID NO: 3461 - DNA, 201 bp, Homo sapiens; identical to SEQ ID NO: 3440

SEQ ID NO: 3462 - DNA, 201 bp, Homo sapiens; identical to SEQ ID NO: 3441

SEQ ID NO: 3463 - DNA, 201 bp, Homo sapiens; identical to SEQ ID NO: 3442

SEQ ID NO: 3464 - DNA, 201 bp, Homo sapiens; identical to SEQ ID NO: 3443

SEQ ID NO: 3465 - DNA, 201 bp, Homo sapiens; identical to SEQ ID NO: 3444

SEQ ID NO: 3466 - DNA, 201 bp, Homo sapiens; identical to SEQ ID NO: 3445

SEQ ID NO: 3467 - DNA, 201 bp, Homo sapiens; identical to SEQ ID NO: 3446

SEQ ID NO: 3468 - DNA, 201 bp, Homo sapiens; identical to SEQ ID NO: 3447

SEQ ID NO: 3469 - DNA, 201 bp, Homo sapiens; identical to SEQ ID NO: 3448

SEQ ID NO: 3470 - DNA, 201 bp, Homo sapiens; identical to SEQ ID NO: 3449

SEQ ID NO: 3471 - DNA, 201 bp, Homo sapiens
ccggtgtgggggtgctccctggagttcccactggagcaggagttaagcccaaggctccaggtgtaggtggagcttttgctggaatcccaggagttggaccytttgggggaccgcaacctggagtcccactggggtatcccatcaaggcccccaagctgcctggtggctatggactgccctacaccacagggaaactgccct

SEQ ID NO: 3472 - DNA, 201 bp, Homo sapiens
tttaaacagcctgctctacttaatactgcctgaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctt

SEQ ID NO: 3473 - DNA, 201 bp, Homo sapiens
tcctggatttcctggcaaagcccaggccttctcacacgcactcagggtgatctgagcagaccacaggctgttcatcccattgggttaaaaagtacttggaracttagttgcagtaaggtcttaggttttgttggggttttttttgtgggaaagtgaaggcatctgcacctgaaatgaaataccagaaagcctccacagcaa

SEQ ID NO: 3474 - DNA, 201 bp, Homo sapiens
tccttccctaaccactttatttccttctgccctatcactgaggtgctttgccagcctcctgtcctacatccgttatccctcagtaagctctctggaacttyccaattgcagccacctcctaatgtccacagcctcctcttctagatctagtttcgtaggcagtccctaagggtagggcccatcctaaaaagttcgactgct

SEQ ID NO: 3475 - DNA, 201 bp, Homo sapiens
aggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggaggtgaacttcttcgaggaaagcagcttcttatcccccaga

SEQ ID NO: 3476 - DNA, 201 bp, Homo sapiens
acacagcccggccctgccttcctggatttcctggcaaagcccaggccttctcacacgcactcagggtgatctgagcagaccacaggctgttcatcccattrggttaaaaagtacttggagacttagttgcagtaaggtcttaggttttgttggggttttttttgtgggaaagtgaaggcatctgcacctgaaatgaaatac

SEQ ID NO: 3477 - DNA, 201 bp, Homo sapiens
caacacagcccggccctgccttcctggatttcctggcaaagcccaggccttctcacacgcactcagggtgatctgagcagaccacaggctgttcatcccawtgggttaaaaagtacttggagacttagttgcagtaaggtcttaggttttgttggggttttttttgtgggaaagtgaaggcatctgcacctgaaatgaaat

SEQ ID NO: 3478 - DNA, 201 bp, Homo sapiens
atctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaa

SEQ ID NO: 3479 - DNA, 201 bp, Homo sapiens
gacccagctgtccctgtccctcaccagcctcacatgcccaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctc

SEQ ID NO: 3480 - DNA, 201 bp, Homo sapiens
tcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatac

SEQ ID NO: 3481 - DNA, 201 bp, Homo sapiens
caccctattcccattctcaggagaaactgtcttcatgtcgatggaaaacccaggtctatggattctggggtgccacaactcagactttcggaacagaggcmtgaccgccttactgaaggtttctagttgtgacaagaacactggtgattattacgaggacagttatgaagatatttcagcatacttgctgagtaaaaacaa

SEQ ID NO: 3482 - DNA, 201 bp, Homo sapiens
ctcaccctattcccattctcaggagaaactgtcttcatgtcgatggaaaacccaggtctatggattctggggtgccacaactcagactttcggaacagagrcatgaccgccttactgaaggtttctagttgtgacaagaacactggtgattattacgaggacagttatgaagatatttcagcatacttgctgagtaaaaac

SEQ ID NO: 3483 - DNA, 201 bp, Homo sapiens
gattactgcttcatcctactttaccaatatgtttgccacctggtctccttcaaaagctcgacttcacctccaagggaggagtaatgcctggagacctcagrtgaataatccaaaagagtggctgcaagtggacttccagaagacaatgaaagtcacaggagtaactactcagggagtaaaatctctgcttaccagcatgta

SEQ ID NO: 3484 - DNA, 201 bp, Homo sapiens
caaaacttacttttggaaagtgcaacatcatatggcacccactaaagatgagtttgactgcaaagcctgggcttatttctctgatgttgacctggaaaaadatgtgcactcaggcctgattggaccccttctggtctgccacactaacacactgaaccctgctcatgggagacaagtgacagtacaggaatttgctctgtt

SEQ ID NO: 3485 - DNA, 201 bp, Homo sapiens
tacttttggaaagtgcaacatcatatggcacccactaaagatgagtttgactgcaaagcctgggcttatttctctgatgttgacctggaaaaagatgtgcvctcaggcctgattggaccccttctggtctgccacactaacacactgaaccctgctcatgggagacaagtgacagtacaggaatttgctctgtttttcacc

SEQ ID NO: 3486 - DNA, 201 bp, Homo sapiens
tggaaagtgcaacatcatatggcacccactaaagatgagtttgactgcaaagcctgggcttatttctctgatgttgacctggaaaaagatgtgcactcagdcctgattggaccccttctggtctgccacactaacacactgaaccctgctcatgggagacaagtgacagtacaggaatttgctctgtttttcaccatcttt

SEQ ID NO: 3487 - DNA, 201 bp, Homo sapiens
caaaagctggtacttcactgaaaatatggaaagaaactgcagggctccctgcaatatccagatggaagatcccacttttaaagagaattatcgcttccatrcaatcaatggctacataatggatacactacctggcttagtaatggctcaggatcaaaggattcgatggtatctgctcagcatgggcagcaatgaaaacat

SEQ ID NO: 3488 - DNA, 201 bp, Homo sapiens
ctggtacttcactgaaaatatggaaagaaactgcagggctccctgcaatatccagatggaagatcccacttttaaagagaattatcgcttccatgcaatcratggctacataatggatacactacctggcttagtaatggctcaggatcaaaggattcgatggtatctgctcagcatgggcagcaatgaaaacatccattc

SEQ ID NO: 3489 - DNA, 201 bp, Homo sapiens
tggtacttcactgaaaatatggaaagaaactgcagggctccctgcaatatccagatggaagatcccacttttaaagagaattatcgcttccatgcaatcartggctacataatggatacactacctggcttagtaatggctcaggatcaaaggattcgatggtatctgctcagcatgggcagcaatgaaaacatccattct

SEQ ID NO: 3490 - DNA, 201 bp, Homo sapiens
tgttgacctggaaaaagatgtgcactcaggcctgattggaccccttctggtctgccacactaacacactgaaccctgctcatgggagacaagtgacagtayaggaatttgctctgtttttcaccatctttgatgagaccaaaagctggtacttcactgaaaatatggaaagaaactgcagggctccctgcaatatccagat

SEQ ID NO: 3491 - DNA, 201 bp, Homo sapiens
tacttcactgaaaatatggaaagaaactgcagggctccctgcaatatccagatggaagatcccacttttaaagagaattatcgcttccatgcaatcaatgsctacataatggatacactacctggcttagtaatggctcaggatcaaaggattcgatggtatctgctcagcatgggcagcaatgaaaacatccattctatt

SEQ ID NO: 3492 - DNA, 201 bp, Homo sapiens
gacctggaaaaagatgtgcactcaggcctgattggaccccttctggtctgccacactaacacactgaaccctgctcatgggagacaagtgacagtacaggratttgctctgtttttcaccatctttgatgagaccaaaagctggtacttcactgaaaatatggaaagaaactgcagggctccctgcaatatccagatggaa

SEQ ID NO: 3493 - DNA, 201 bp, Homo sapiens
agcatgggcagcaatgaaaacatccattctattcatttcagtggacatgtgttcactgtacgaaaaaaagaggagtataaaatggcactgtacaatctctrtccaggtgtttttgagacagtggaaatgttaccatccaaagctggaatttggcgggtggaatgccttattggcgagcatctacatgctgggatgagcaca

SEQ ID NO: 3494 - DNA, 201 bp, Homo sapiens
ctcaggcctgattggaccccttctggtctgccacactaacacactgaaccctgctcatgggagacaagtgacagtacaggaatttgctctgtttttcaccwtctttgatgagaccaaaagctggtacttcactgaaaatatggaaagaaactgcagggctccctgcaatatccagatggaagatcccacttttaaagagaa

SEQ ID NO: 3495 - DNA, 201 bp, Homo sapiens
gattggaccccttctggtctgccacactaacacactgaaccctgctcatgggagacaagtgacagtacaggaatttgctctgtttttcaccatctttgatragaccaaaagctggtacttcactgaaaatatggaaagaaactgcagggctccctgcaatatccagatggaagatcccacttttaaagagaattatcgctt

SEQ ID NO: 3496 - DNA, 201 bp, Homo sapiens
ctggtctgccacactaacacactgaaccctgctcatgggagacaagtgacagtacaggaatttgctctgtttttcaccatctttgatgagaccaaaagctkgtacttcactgaaaatatggaaagaaactgcagggctccctgcaatatccagatggaagatcccacttttaaagagaattatcgcttccatgcaatcaat

SEQ ID NO: 3497 - DNA, 201 bp, Homo sapiens
gcagggctccctgcaatatccagatggaagatcccacttttaaagagaattatcgcttccatgcaatcaatggctacataatggatacactacctggcttwgtaatggctcaggatcaaaggattcgatggtatctgctcagcatgggcagcaatgaaaacatccattctattcatttcagtggacatgtgttcactgtac

SEQ ID NO: 3498 - DNA, 201 bp, Homo sapiens
tggcatgtgattggaatgggcaccactcctgaagtgcactcaatattcctcgaaggtcacacatttcttgtgaggaaccatcgccaggcgtccttggaaakctcgccaataactttccttactgctcaaacactcttgatggaccttggacagtttctactgttttgtcatatctcttcccaccaacatgatggcatggaa

SEQ ID NO: 3499 - DNA, 201 bp, Homo sapiens
ggaagatcccacttttaaagagaattatcgcttccatgcaatcaatggctacataatggatacactacctggcttagtaatggctcaggatcaaaggattygatggtatctgctcagcatgggcagcaatgaaaacatccattctattcatttcagtggacatgtgttcactgtacgaaaaaaagaggagtataaaatggc

SEQ ID NO: 3500 - DNA, 201 bp, Homo sapiens
agacaagaggaatgtcatcctgttttctgtatttgatgagaaccgaagctggtacctcacagagaatatacaacgctttctccccaatccagctggagtgyagcttgaggatccagagttccaagcctccaacatcatgcacagcatcaatggctatgtttttgatagtttgcagttgtcagtttgtttgcatgaggtggc

SEQ ID NO: 3501 - DNA, 201 bp, Homo sapiens
gaagatcccacttttaaagagaattatcgcttccatgcaatcaatggctacataatggatacactacctggcttagtaatggctcaggatcaaaggattcdatggtatctgctcagcatgggcagcaatgaaaacatccattctattcatttcagtggacatgtgttcactgtacgaaaaaaagaggagtataaaatggca

SEQ ID NO: 3502 - DNA, 201 bp, Homo sapiens
tgtagatcaaagaggaaaccagataatgtcagacaagaggaatgtcatcctgttttctgtatttgatgagaaccgaagctggtacctcacagagaatatayaacgctttctccccaatccagctggagtgcagcttgaggatccagagttccaagcctccaacatcatgcacagcatcaatggctatgtttttgatagttt

SEQ ID NO: 3503 - DNA, 201 bp, Homo sapiens
gcgaggcacaggacctctactgagggtggccactgcagcacctgccactgccgtcacctctccctcctcagctccagggcagtgtccctccctggcttgcyttctacctttgtgctaaatcctagcagacactgccttgaagcctcctgaattaactatcatcagtcctgcatttctttggtggggggccaggagggtgca

SEQ ID NO: 3504 - DNA, 201 bp, Homo sapiens
gccaggtctgattggatgccacaggaaatcagtctattggcatgtgattggaatgggcaccactcctgaagtgcactcaatattcctcgaaggtcacacayttcttgtgaggaaccatcgccaggcgtccttggaaatctcgccaataactttccttactgctcaaacactcttgatggaccttggacagtttctactgtt

SEQ ID NO: 3505 - DNA, 201 bp, Homo sapiens
gtcaatggttatgtaaacaggtctctgccaggtctgattggatgccacaggaaatcagtctattggcatgtgattggaatgggcaccactcctgaagtgcmctcaatattcctcgaaggtcacacatttcttgtgaggaaccatcgccaggcgtccttggaaatctcgccaataactttccttactgctcaaacactcttg

SEQ ID NO: 3506 - DNA, 201 bp, Homo sapiens
ttcgttaatatggagagagatctagcttcaggactcattggccctctcctcatctgctacaaagaatctgtagatcaaagaggaaaccagataatgtcagrcaagaggaatgtcatcctgttttctgtatttgatgagaaccgaagctggtacctcacagagaatatacaacgctttctccccaatccagctggagtgcag

SEQ ID NO: 3507 - DNA, 201 bp, Homo sapiens
agatcaaagaggaaaccagataatgtcagacaagaggaatgtcatcctgttttctgtatttgatgagaaccgaagctggtacctcacagagaatatacaaygctttctccccaatccagctggagtgcagcttgaggatccagagttccaagcctccaacatcatgcacagcatcaatggctatgtttttgatagtttgca

SEQ ID NO: 3508 - DNA, 201 bp, Homo sapiens
atctgctacaaagaatctgtagatcaaagaggaaaccagataatgtcagacaagaggaatgtcatcctgttttctgtatttgatgagaaccgaagctggtmcctcacagagaatatacaacgctttctccccaatccagctggagtgcagcttgaggatccagagttccaagcctccaacatcatgcacagcatcaatggc

SEQ ID NO: 3509 - DNA, 201 bp, Homo sapiens
atgattcaacaaatagaacaaagaaacacacagctcatttctcaaaaaaaggggaggaagaaaacttggaaggcttgggaaatcaaaccaagcaaattgtmgagaaatatgcatgcaccacaaggatatctcctaatacaagccagcagaattttgtcacgcaacgtagtaagagagctttgaaacaattcagactcccac

SEQ ID NO: 3510 - DNA, 201 bp, Homo sapiens
aacatcatgcacagcatcaatggctatgtttttgatagtttgcagttgtcagtttgtttgcatgaggtggcatactggtacattctaagcattggagcacmgactgacttcctttctgtcttcttctctggatataccttcaaacacaaaatggtctatgaagacacactcaccctattcccattctcaggagaaactgtc

SEQ ID NO: 3511 - DNA, 201 bp, Homo sapiens
catctgctacaaagaatctgtagatcaaagaggaaaccagataatgtcagacaagaggaatgtcatcctgttttctgtatttgatgagaaccgaagctggyacctcacagagaatatacaacgctttctccccaatccagctggagtgcagcttgaggatccagagttccaagcctccaacatcatgcacagcatcaatgg

SEQ ID NO: 3512 - DNA, 201 bp, Homo sapiens
atgtagttttgcctcagatacatacagtgactggcactaagaatttcatgaagaaccttttcttactgagcactaggcaaaatgtagaaggttcatatgasggggcatatgctccagtacttcaagattttaggtcattaaatgattcaacaaatagaacaaagaaacacacagctcatttctcaaaaaaaggggaggaag

SEQ ID NO: 3513 - DNA, 201 bp, Homo sapiens
tcatctgctacaaagaatctgtagatcaaagaggaaaccagataatgtcagacaagaggaatgtcatcctgttttctgtatttgatgagaaccgaagctgstacctcacagagaatatacaacgctttctccccaatccagctggagtgcagcttgaggatccagagttccaagcctccaacatcatgcacagcatcaatg

SEQ ID NO: 3514 - DNA, 201 bp, Homo sapiens
tcctcatctgctacaaagaatctgtagatcaaagaggaaaccagataatgtcagacaagaggaatgtcatcctgttttctgtatttgatgagaaccgaagstggtacctcacagagaatatacaacgctttctccccaatccagctggagtgcagcttgaggatccagagttccaagcctccaacatcatgcacagcatca

SEQ ID NO: 3515 - DNA, 201 bp, Homo sapiens
ggcagcaatgaaaacatccattctattcatttcagtggacatgtgttcactgtacgaaaaaaagaggagtataaaatggcactgtacaatctctatccagstgtttttgagacagtggaaatgttaccatccaaagctggaatttggcgggtggaatgccttattggcgagcatctacatgctgggatgagcacacttttt

SEQ ID NO: 3516 - DNA, 201 bp, Homo sapiens
caagtgacagtacaggaatttgctctgtttttcaccatctttgatgagaccaaaagctggtacttcactgaaaatatggaaagaaactgcagggctccctscaatatccagatggaagatcccacttttaaagagaattatcgcttccatgcaatcaatggctacataatggatacactacctggcttagtaatggctcag

SEQ ID NO: 3517 - DNA, 201 bp, Homo sapiens
ccattctattcatttcagtggacatgtgttcactgtacgaaaaaaagaggagtataaaatggcactgtacaatctctatccaggtgtttttgagacagtgkaaatgttaccatccaaagctggaatttggcgggtggaatgccttattggcgagcatctacatgctgggatgagcacactttttctggtgtacagcaataa

SEQ ID NO: 3518 - DNA, 201 bp, Homo sapiens
gagacagtggaaatgttaccatccaaagctggaatttggcgggtggaatgccttattggcgagcatctacatgctgggatgagcacactttttctggtgtrcagcaataagtgtcagactcccctgggaatggcttctggacacattagagattttcagattacagcttcaggacaatatggacagtgggccccaaagctg

SEQ ID NO: 3519 - DNA, 201 bp, Homo sapiens
gtggaaatgttaccatccaaagctggaatttggcgggtggaatgccttattggcgagcatctacatgctgggatgagcacactttttctggtgtacagcartaagtgtcagactcccctgggaatggcttctggacacattagagattttcagattacagcttcaggacaatatggacagtgggccccaaagctggccaga

SEQ ID NO: 3520 - DNA, 201 bp, Homo sapiens
tgttaccatccaaagctggaatttggcgggtggaatgccttattggcgagcatctacatgctgggatgagcacactttttctggtgtacagcaataagtgwcagactcccctgggaatggcttctggacacattagagattttcagattacagcttcaggacaatatggacagtgggccccaaagctggccagacttcatt

SEQ ID NO: 3521 - DNA, 201 bp, Homo sapiens
gatcccacttttaaagagaattatcgcttccatgcaatcaatggctacataatggatacactacctggcttagtaatggctcaggatcaaaggattcgatrgtatctgctcagcatgggcagcaatgaaaacatccattctattcatttcagtggacatgtgttcactgtacgaaaaaaagaggagtataaaatggcactg

SEQ ID NO: 3522 - DNA, 201 bp, Homo sapiens
agaattatcgcttccatgcaatcaatggctacataatggatacactacctggcttagtaatggctcaggatcaaaggattcgatggtatctgctcagcatrggcagcaatgaaaacatccattctattcatttcagtggacatgtgttcactgtacgaaaaaaagaggagtataaaatggcactgtacaatctctatccag

SEQ ID NO: 3523 - DNA, 201 bp, Homo sapiens
catgcaatcaatggctacataatggatacactacctggcttagtaatggctcaggatcaaaggattcgatggtatctgctcagcatgggcagcaatgaaamcatccattctattcatttcagtggacatgtgttcactgtacgaaaaaaagaggagtataaaatggcactgtacaatctctatccaggtgtttttgagaca

SEQ ID NO: 3524 - DNA, 201 bp, Homo sapiens
tttaaccctccaattattgctcgatacatccgtttgcacccaactcattatagcattcgcagcactcttcgcatggagttgatgggctgtgatttaaatakttgcagcatgccattgggaatggagagtaaagcaatatcagatgcacagattactgcttcatcctactttaccaatatgtttgccacctggtctccttca

SEQ ID NO: 3525 - DNA, 201 bp, Homo sapiens
atcaatggctacataatggatacactacctggcttagtaatggctcaggatcaaaggattcgatggtatctgctcagcatgggcagcaatgaaaacatccwttctattcatttcagtggacatgtgttcactgtacgaaaaaaagaggagtataaaatggcactgtacaatctctatccaggtgtttttgagacagtggaa

SEQ ID NO: 3526 - DNA, 201 bp, Homo sapiens
gatacactacctggcttagtaatggctcaggatcaaaggattcgatggtatctgctcagcatgggcagcaatgaaaacatccattctattcatttcagtgdacatgtgttcactgtacgaaaaaaagaggagtataaaatggcactgtacaatctctatccaggtgtttttgagacagtggaaatgttaccatccaaagct

SEQ ID NO: 3527 - DNA, 201 bp, Homo sapiens
tacactacctggcttagtaatggctcaggatcaaaggattcgatggtatctgctcagcatgggcagcaatgaaaacatccattctattcatttcagtggabatgtgttcactgtacgaaaaaaagaggagtataaaatggcactgtacaatctctatccaggtgtttttgagacagtggaaatgttaccatccaaagctgg

SEQ ID NO: 3528 - DNA, 201 bp, Homo sapiens
ctattcatttcagtggacatgtgttcactgtacgaaaaaaagaggagtataaaatggcactgtacaatctctatccaggtgtttttgagacagtggaaatrttaccatccaaagctggaatttggcgggtggaatgccttattggcgagcatctacatgctgggatgagcacactttttctggtgtacagcaataagtgtc

SEQ ID NO: 3529 - DNA, 201 bp, Homo sapiens
cactgtacgaaaaaaagaggagtataaaatggcactgtacaatctctatccaggtgtttttgagacagtggaaatgttaccatccaaagctggaatttggygggtggaatgccttattggcgagcatctacatgctgggatgagcacactttttctggtgtacagcaataagtgtcagactcccctgggaatggcttctgg

SEQ ID NO: 3530 - DNA, 201 bp, Homo sapiens
gagtataaaatggcactgtacaatctctatccaggtgtttttgagacagtggaaatgttaccatccaaagctggaatttggcgggtggaatgccttattgrcgagcatctacatgctgggatgagcacactttttctggtgtacagcaataagtgtcagactcccctgggaatggcttctggacacattagagattttcag

SEQ ID NO: 3531 - DNA, 201 bp, Homo sapiens
ttttttcagaatggcaaagtaaaggtttttcagggaaatcaagactccttcacacctgtggtgaactctctagacccaccgttactgactcgctaccttcraattcacccccagagttgggtgcaccagattgccctgaggatggaggttctgggctgcgaggcacaggacctctactgagggtggccactgcagcacctg

SEQ ID NO: 3532 - DNA, 201 bp, Homo sapiens
tacatagttgaaatatcaaggaggtcagaagaaaattggactggtgaaaacagaaaaaacactccagtctgccatatcaccacacaataggatcccccttyttgccctccacccccataagattgtgaagggtttactgctccttccatctgcctgaccccttcactatgactacacagaatctcctgatagtaaaggggg

SEQ ID NO: 3533 - DNA, 201 bp, Homo sapiens
agcatgaatcaggaatcttgggacctttactttatggggaagttggagacacactgttgattatatttaagaatcaagcaagcagaccatataacatctascctcacggaatcactgatgtccgtcctttgtattcaaggagattaccaaaaggtgtaaaacatttgaaggattttccaattctgccaggagaaatattca

SEQ ID NO: 3534 - DNA, 201 bp, Homo sapiens
ccctctcctcatctgctacaaagaatctgtagatcaaagaggaaaccagataatgtcagacaagaggaatgtcatcctgttttctgtatttgatgagaacbgaagctggtacctcacagagaatatacaacgctttctccccaatccagctggagtgcagcttgaggatccagagttccaagcctccaacatcatgcacag

SEQ ID NO: 3535 - DNA, 201 bp, Homo sapiens
gccctctcctcatctgctacaaagaatctgtagatcaaagaggaaaccagataatgtcagacaagaggaatgtcatcctgttttctgtatttgatgagaascgaagctggtacctcacagagaatatacaacgctttctccccaatccagctggagtgcagcttgaggatccagagttccaagcctccaacatcatgcaca

SEQ ID NO: 3536 - DNA, 201 bp, Homo sapiens
tggccctctcctcatctgctacaaagaatctgtagatcaaagaggaaaccagataatgtcagacaagaggaatgtcatcctgttttctgtatttgatgagraccgaagctggtacctcacagagaatatacaacgctttctccccaatccagctggagtgcagcttgaggatccagagttccaagcctccaacatcatgca

SEQ ID NO: 3537 - DNA, 201 bp, Homo sapiens
cattggccctctcctcatctgctacaaagaatctgtagatcaaagaggaaaccagataatgtcagacaagaggaatgtcatcctgttttctgtatttgatkagaaccgaagctggtacctcacagagaatatacaacgctttctccccaatccagctggagtgcagcttgaggatccagagttccaagcctccaacatcat

SEQ ID NO: 3538 - DNA, 201 bp, Homo sapiens
tattactctagtttcgttaatatggagagagatctagcttcaggactcattggccctctcctcatctgctacaaagaatctgtagatcaaagaggaaaccrgataatgtcagacaagaggaatgtcatcctgttttctgtatttgatgagaaccgaagctggtacctcacagagaatatacaacgctttctccccaatcca

SEQ ID NO: 3539 - DNA, 201 bp, Homo sapiens
ttcaaatataaatggacagtgactgtagaagatgggccaactaaatcagatcctcggtgcctgacccgctattactctagtttcgttaatatggagagagvtctagcttcaggactcattggccctctcctcatctgctacaaagaatctgtagatcaaagaggaaaccagataatgtcagacaagaggaatgtcatcctg

SEQ ID NO: 3540 - DNA, 201 bp, Homo sapiens
tttgagacagtggaaatgttaccatccaaagctggaatttggcgggtggaatgccttattggcgagcatctacatgctgggatgagcacactttttctggygtacagcaataagtgtcagactcccctgggaatggcttctggacacattagagattttcagattacagcttcaggacaatatggacagtgggccccaaag

SEQ ID NO: 3541 - DNA, 201 bp, Homo sapiens
attaaccttttgcttctccagttgaacatttgtagcaataagtcatgcaaatagagctctccacctgcttctttctgtgccttttgcgattctgctttagkgccaccagaagatactacctgggtgcagtggaactgtcatgggactatatgcaaagtgatctcggtgagctgcctgtggacgcaagatttcctcctagag

SEQ ID NO: 3542 - DNA, 201 bp, Homo sapiens
atgttaccatccaaagctggaatttggcgggtggaatgccttattggcgagcatctacatgctgggatgagcacactttttctggtgtacagcaataagtrtcagactcccctgggaatggcttctggacacattagagattttcagattacagcttcaggacaatatggacagtgggccccaaagctggccagacttcat

SEQ ID NO: 3543 - DNA, 201 bp, Homo sapiens
tctccagttgaacatttgtagcaataagtcatgcaaatagagctctccacctgcttctttctgtgccttttgcgattctgctttagtgccaccagaagatrctacctgggtgcagtggaactgtcatgggactatatgcaaagtgatctcggtgagctgcctgtggacgcaagatttcctcctagagtgccaaaatctttt

SEQ ID NO: 3544 - DNA, 201 bp, Homo sapiens
gctggaatttggcgggtggaatgccttattggcgagcatctacatgctgggatgagcacactttttctggtgtacagcaataagtgtcagactcccctggdaatggcttctggacacattagagattttcagattacagcttcaggacaatatggacagtgggccccaaagctggccagacttcattattccggatcaatc

SEQ ID NO: 3545 - DNA, 201 bp, Homo sapiens
gttgaacatttgtagcaataagtcatgcaaatagagctctccacctgcttctttctgtgccttttgcgattctgctttagtgccaccagaagatactaccbgggtgcagtggaactgtcatgggactatatgcaaagtgatctcggtgagctgcctgtggacgcaagatttcctcctagagtgccaaaatcttttccattc

SEQ ID NO: 3546 - DNA, 201 bp, Homo sapiens
tagcaataagtcatgcaaatagagctctccacctgcttctttctgtgccttttgcgattctgctttagtgccaccagaagatactacctgggtgcagtggwactgtcatgggactatatgcaaagtgatctcggtgagctgcctgtggacgcaagatttcctcctagagtgccaaaatcttttccattcaacacctcagtc

SEQ ID NO: 3547 - DNA, 201 bp, Homo sapiens
agtaaaggtttttcagggaaatcaagactccttcacacctgtggtgaactctctagacccaccgttactgactcgctaccttcgaattcacccccagagtygggtgcaccagattgccctgaggatggaggttctgggctgcgaggcacaggacctctactgagggtggccactgcagcacctgccactgccgtcacctct

SEQ ID NO: 3548 - DNA, 201 bp, Homo sapiens
ccatacatatgtctggcaggtcctgaaagagaatggtccaatggcctctgacccactgtgccttacctactcatatctttctcatgtggacctggtaaaakacttgaattcaggcctcattggagccctactagtatgtagagaagggagtctggccaaggaaaagacacagaccttgcacaaatttatactactttttgc

SEQ ID NO: 3549 - DNA, 201 bp, Homo sapiens
atgccattgggaatggagagtaaagcaatatcagatgcacagattactgcttcatcctactttaccaatatgtttgccacctggtctccttcaaaagctcracttcacctccaagggaggagtaatgcctggagacctcaggtgaataatccaaaagagtggctgcaagtggacttccagaagacaatgaaagtcacagga

SEQ ID NO: 3550 - DNA, 201 bp, Homo sapiens
agccatacatatgtctggcaggtcctgaaagagaatggtccaatggcctctgacccactgtgccttacctactcatatctttctcatgtggacctggtaamagacttgaattcaggcctcattggagccctactagtatgtagagaagggagtctggccaaggaaaagacacagaccttgcacaaatttatactacttttt

SEQ ID NO: 3551 - DNA, 201 bp, Homo sapiens
attcaaatataaatggacagtgactgtagaagatgggccaactaaatcagatcctcggtgcctgacccgctattactctagtttcgttaatatggagagabatctagcttcaggactcattggccctctcctcatctgctacaaagaatctgtagatcaaagaggaaaccagataatgtcagacaagaggaatgtcatcct

SEQ ID NO: 3552 - DNA, 201 bp, Homo sapiens
atattcaaatataaatggacagtgactgtagaagatgggccaactaaatcagatcctcggtgcctgacccgctattactctagtttcgttaatatggagasagatctagcttcaggactcattggccctctcctcatctgctacaaagaatctgtagatcaaagaggaaaccagataatgtcagacaagaggaatgtcatc

SEQ ID NO: 3553 - DNA, 201 bp, Homo sapiens
ctgccaggagaaatattcaaatataaatggacagtgactgtagaagatgggccaactaaatcagatcctcggtgcctgacccgctattactctagtttcgwtaatatggagagagatctagcttcaggactcattggccctctcctcatctgctacaaagaatctgtagatcaaagaggaaaccagataatgtcagacaag

SEQ ID NO: 3554 - DNA, 201 bp, Homo sapiens
tccaattctgccaggagaaatattcaaatataaatggacagtgactgtagaagatgggccaactaaatcagatcctcggtgcctgacccgctattactctdgtttcgttaatatggagagagatctagcttcaggactcattggccctctcctcatctgctacaaagaatctgtagatcaaagaggaaaccagataatgtc

SEQ ID NO: 3555 - DNA, 201 bp, Homo sapiens
ttttccaattctgccaggagaaatattcaaatataaatggacagtgactgtagaagatgggccaactaaatcagatcctcggtgcctgacccgctattacyctagtttcgttaatatggagagagatctagcttcaggactcattggccctctcctcatctgctacaaagaatctgtagatcaaagaggaaaccagataat

SEQ ID NO: 3556 - DNA, 201 bp, Homo sapiens
ttgaaggattttccaattctgccaggagaaatattcaaatataaatggacagtgactgtagaagatgggccaactaaatcagatcctcggtgcctgacccrctattactctagtttcgttaatatggagagagatctagcttcaggactcattggccctctcctcatctgctacaaagaatctgtagatcaaagaggaaac

SEQ ID NO: 3557 - DNA, 201 bp, Homo sapiens
tttgaaggattttccaattctgccaggagaaatattcaaatataaatggacagtgactgtagaagatgggccaactaaatcagatcctcggtgcctgaccbgctattactctagtttcgttaatatggagagagatctagcttcaggactcattggccctctcctcatctgctacaaagaatctgtagatcaaagaggaaa

SEQ ID NO: 3558 - DNA, 201 bp, Homo sapiens
aggtgtaaaacatttgaaggattttccaattctgccaggagaaatattcaaatataaatggacagtgactgtagaagatgggccaactaaatcagatcctyggtgcctgacccgctattactctagtttcgttaatatggagagagatctagcttcaggactcattggccctctcctcatctgctacaaagaatctgtaga

SEQ ID NO: 3559 - DNA, 201 bp, Homo sapiens
accaaaaggtgtaaaacatttgaaggattttccaattctgccaggagaaatattcaaatataaatggacagtgactgtagaagatgggccaactaaatcaratcctcggtgcctgacccgctattactctagtttcgttaatatggagagagatctagcttcaggactcattggccctctcctcatctgctacaaagaatc

SEQ ID NO: 3560 - DNA, 201 bp, Homo sapiens
aaggagattaccaaaaggtgtaaaacatttgaaggattttccaattctgccaggagaaatattcaaatataaatggacagtgactgtagaagatgggccawctaaatcagatcctcggtgcctgacccgctattactctagtttcgttaatatggagagagatctagcttcaggactcattggccctctcctcatctgcta

SEQ ID NO: 3561 - DNA, 201 bp, Homo sapiens
gagctgcctgtggacgcaagatttcctcctagagtgccaaaatcttttccattcaacacctcagtcgtgtacaaaaagactctgtttgtagaattcacggwtcaccttttcaacatcgctaagccaaggccaccctggatgggtctgctaggtcctaccatccaggctgaggtttatgatacagtggtcattacacttaag

SEQ ID NO: 3562 - DNA, 201 bp, Homo sapiens
gtcatatctcttcccaccaacatgatggcatggaagcttatgtcaaagtagacagctgtccagaggaaccccaactacgaatgaaaaataatgaagaagcrgaagactatgatgatgatcttactgattctgaaatggatgtggtcaggtttgatgatgacaactctccttcctttatccaaattcgctcagttgccaaga

SEQ ID NO: 3563 - DNA, 201 bp, Homo sapiens
catgggactatatgcaaagtgatctcggtgagctgcctgtggacgcaagatttcctcctagagtgccaaaatcttttccattcaacacctcagtcgtgtamaaaaagactctgtttgtagaattcacggatcaccttttcaacatcgctaagccaaggccaccctggatgggtctgctaggtcctaccatccaggctgagg

SEQ ID NO: 3564 - DNA, 201 bp, Homo sapiens
ttcaacacctcagtcgtgtacaaaaagactctgtttgtagaattcacggatcaccttttcaacatcgctaagccaaggccaccctggatgggtctgctagbtcctaccatccaggctgaggtttatgatacagtggtcattacacttaagaacatggcttcccatcctgtcagtcttcatgctgttggtgtatcctactgg

SEQ ID NO: 3565 - DNA, 201 bp, Homo sapiens
tggctgcaagtggacttccagaagacaatgaaagtcacaggagtaactactcagggagtaaaatctctgcttaccagcatgtatgtgaaggagttcctcayctccagcagtcaagatggccatcagtggactctcttttttcagaatggcaaagtaaaggtttttcagggaaatcaagactccttcacacctgtggtgaac

SEQ ID NO: 3566 - DNA, 201 bp, Homo sapiens
gatcaccttttcaacatcgctaagccaaggccaccctggatgggtctgctaggtcctaccatccaggctgaggtttatgatacagtggtcattacacttamgaacatggcttcccatcctgtcagtcttcatgctgttggtgtatcctactggaaagcttctgagggagctgaatatgatgatcagaccagtcaaagggag

SEQ ID NO: 3567 - DNA, 201 bp, Homo sapiens
ccttttcaacatcgctaagccaaggccaccctggatgggtctgctaggtcctaccatccaggctgaggtttatgatacagtggtcattacacttaagaacrtggcttcccatcctgtcagtcttcatgctgttggtgtatcctactggaaagcttctgagggagctgaatatgatgatcagaccagtcaaagggagaaaga

SEQ ID NO: 3568 - DNA, 201 bp, Homo sapiens
atcgctaagccaaggccaccctggatgggtctgctaggtcctaccatccaggctgaggtttatgatacagtggtcattacacttaagaacatggcttcccrtcctgtcagtcttcatgctgttggtgtatcctactggaaagcttctgagggagctgaatatgatgatcagaccagtcaaagggagaaagaagatgataaa

SEQ ID NO: 3569 - DNA, 201 bp, Homo sapiens
tgttctaagaaacagggctcagagtggcagtgtccctcagttcaagaaagttgttttccaggaatttactgatggctcctttactcagcccttataccgtrgagaactaaatgaacatttgggactcctggggccatatataagagcagaagttgaagataatatcatggtaactttcagaaatcaggcctctcgtcccta

SEQ ID NO: 3570 - DNA, 201 bp, Homo sapiens
gaatatgatgatcagaccagtcaaagggagaaagaagatgataaagtcttccctggtggaagccatacatatgtctggcaggtcctgaaagagaatggtcyaatggcctctgacccactgtgccttacctactcatatctttctcatgtggacctggtaaaagacttgaattcaggcctcattggagccctactagtatgt

SEQ ID NO: 3571 - DNA, 201 bp, Homo sapiens
acctgtggtgaactctctagacccaccgttactgactcgctaccttcgaattcacccccagagttgggtgcaccagattgccctgaggatggaggttctgdgctgcgaggcacaggacctctactgagggtggccactgcagcacctgccactgccgtcacctctccctcctcagctccagggcagtgtccctccctggct

SEQ ID NO: 3572 - DNA, 201 bp, Homo sapiens
ttcccatcctgtcagtcttcatgctgttggtgtatcctactggaaagcttctgagggagctgaatatgatgatcagaccagtcaaagggagaaagaagatsataaagtcttccctggtggaagccatacatatgtctggcaggtcctgaaagagaatggtccaatggcctctgacccactgtgccttacctactcatatct

SEQ ID NO: 3573 - DNA, 201 bp, Homo sapiens
tctccccttactgagtctggtggacctctgagcttgagtgaagaaaataatgattcaaagttgttagaatcaggtttaatgaatagccaagaaagttcatrgggaaaaaatgtatcgtcaacagagagtggtaggttatttaaagggaaaagagctcatggacctgctttgttgactaaagataatgccttattcaaagtt

SEQ ID NO: 3574 - DNA, 201 bp, Homo sapiens
atcaggaatcttgggacctttactttatggggaagttggagacacactgttgattatatttaagaatcaagcaagcagaccatataacatctaccctcacrgaatcactgatgtccgtcctttgtattcaaggagattaccaaaaggtgtaaaacatttgaaggattttccaattctgccaggagaaatattcaaatataa

SEQ ID NO: 3575 - DNA, 201 bp, Homo sapiens
gtggactctcttttttcagaatggcaaagtaaaggtttttcagggaaatcaagactccttcacacctgtggtgaactctctagacccaccgttactgactbgctaccttcgaattcacccccagagttgggtgcaccagattgccctgaggatggaggttctgggctgcgaggcacaggacctctactgagggtggccact

SEQ ID NO: 3576 - DNA, 201 bp, Homo sapiens
caagactccttcacacctgtggtgaactctctagacccaccgttactgactcgctaccttcgaattcacccccagagttgggtgcaccagattgccctgasgatggaggttctgggctgcgaggcacaggacctctactgagggtggccactgcagcacctgccactgccgtcacctctccctcctcagctccagggcagt

SEQ ID NO: 3577 - DNA, 201 bp, Homo sapiens
gtgaatttacaaaggacgtaggactcaaagagatggtttttccaagcagcagaaacctatttcttactaacttggataatttacatgaaaataatacacayaatcaagaaaaaaaaattcaggaagaaatagaaaagaaggaaacattaatccaagagaatgtagttttgcctcagatacatacagtgactggcactaaga

SEQ ID NO: 3578 - DNA, 201 bp, Homo sapiens
agtaatggctcaggatcaaaggattcgatggtatctgctcagcatgggcagcaatgaaaacatccattctattcatttcagtggacatgtgttcactgtaygaaaaaaagaggagtataaaatggcactgtacaatctctatccaggtgtttttgagacagtggaaatgttaccatccaaagctggaatttggcgggtgga

SEQ ID NO: 3579 - DNA, 201 bp, Homo sapiens
ccctattcccattctcaggagaaactgtcttcatgtcgatggaaaacccaggtctatggattctggggtgccacaactcagactttcggaacagaggcatsaccgccttactgaaggtttctagttgtgacaagaacactggtgattattacgaggacagttatgaagatatttcagcatacttgctgagtaaaaacaatg

SEQ ID NO: 3580 - DNA, 201 bp, Homo sapiens
ttctcaggagaaactgtcttcatgtcgatggaaaacccaggtctatggattctggggtgccacaactcagactttcggaacagaggcatgaccgccttacwgaaggtttctagttgtgacaagaacactggtgattattacgaggacagttatgaagatatttcagcatacttgctgagtaaaaacaatgccattgaacca

SEQ ID NO: 3581 - DNA, 201 bp, Homo sapiens
tttcggaacagaggcatgaccgccttactgaaggtttctagttgtgacaagaacactggtgattattacgaggacagttatgaagatatttcagcatactwgctgagtaaaaacaatgccattgaaccaagaagcttctcccagaattcaagacaccctagcactaggcaaaagcaatttaatgccaccacaattccagaa

SEQ ID NO: 3582 - DNA, 201 bp, Homo sapiens
ggaaattccactggaaccttaatggtcttctttggcaatgtggattcatctgggataaaacacaatatttttaaccctccaattattgctcgatacatccrtttgcacccaactcattatagcattcgcagcactcttcgcatggagttgatgggctgtgatttaaatagttgcagcatgccattgggaatggagagtaaa

SEQ ID NO: 3583 - DNA, 201 bp, Homo sapiens
cagttatgaagatatttcagcatacttgctgagtaaaaacaatgccattgaaccaagaagcttctcccagaattcaagacaccctagcactaggcaaaagyaatttaatgccaccacaattccagaaaatgacatagagaagactgacccttggtttgcacacagaacacctatgcctaaaatacaaaatgtctcctctag

SEQ ID NO: 3584 - DNA, 201 bp, Homo sapiens
tttaccaatatgtttgccacctggtctccttcaaaagctcgacttcacctccaagggaggagtaatgcctggagacctcaggtgaataatccaaaagagtsgctgcaagtggacttccagaagacaatgaaagtcacaggagtaactactcagggagtaaaatctctgcttaccagcatgtatgtgaaggagttcctcatc

SEQ ID NO: 3585 - DNA, 201 bp, Homo sapiens
agaggaatgtcatcctgttttctgtatttgatgagaaccgaagctggtacctcacagagaatatacaacgctttctccccaatccagctggagtgcagctygaggatccagagttccaagcctccaacatcatgcacagcatcaatggctatgtttttgatagtttgcagttgtcagtttgtttgcatgaggtggcatact

SEQ ID NO: 3586 - DNA, 201 bp, Homo sapiens
actatatgcaaagtgatctcggtgagctgcctgtggacgcaagatttcctcctagagtgccaaaatcttttccattcaacacctcagtcgtgtacaaaaasactctgtttgtagaattcacggatcaccttttcaacatcgctaagccaaggccaccctggatgggtctgctaggtcctaccatccaggctgaggtttatg

SEQ ID NO: 3587 - DNA, 201 bp, Homo sapiens
gtatagtcttgatgggaagaagtggcagacttatcgaggaaattccactggaaccttaatggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 3588 - DNA, 201 bp, Homo sapiens
ttccctggtggaagccatacatatgtctggcaggtcctgaaagagaatggtccaatggcctctgacccactgtgccttacctactcatatctttctcatgwggacctggtaaaagacttgaattcaggcctcattggagccctactagtatgtagagaagggagtctggccaaggaaaagacacagaccttgcacaaattt

SEQ ID NO: 3589 - DNA, 201 bp, Homo sapiens
agtccgatttatggcatacacagatgaaacctttaagactcgtgaagctattcagcatgaatcaggaatcttgggacctttactttatggggaagttggaracacactgttgattatatttaagaatcaagcaagcagaccatataacatctaccctcacggaatcactgatgtccgtcctttgtattcaaggagattacc

SEQ ID NO: 3590 - DNA, 201 bp, Homo sapiens
agaaaatgacatagagaagactgacccttggtttgcacacagaacacctatgcctaaaatacaaaatgtctcctctagtgatttgttgatgctcttgcgayagagtcctactccacatgggctatccttatctgatctccaagaagccaaatatgagactttttctgatgatccatcacctggagcaatagacagtaataa

SEQ ID NO: 3591 - DNA, 201 bp, Homo sapiens
tctttgttaaagacaaacaaaacttccaataattcagcaactaatagaaagactcacattgatggcccatcattattaattgagaatagtccatcagtctrgcaaaatatattagaaagtgacactgagtttaaaaaagtgacacctttgattcatgacagaatgcttatggacaaaaatgctacagctttgaggctaaat

SEQ ID NO: 3592 - DNA, 201 bp, Homo sapiens
gattcatgacagaatgcttatggacaaaaatgctacagctttgaggctaaatcatatgtcaaataaaactacttcatcaaaaaacatggaaatggtccaayagaaaaaagagggccccattccaccagatgcacaaaatccagatatgtcgttctttaagatgctattcttgccagaatcagcaaggtggatacaaaggac

SEQ ID NO: 3593 - DNA, 201 bp, Homo sapiens
aaatggtccaacagaaaaaagagggccccattccaccagatgcacaaaatccagatatgtcgttctttaagatgctattcttgccagaatcagcaaggtgratacaaaggactcatggaaagaactctctgaactctgggcaaggccccagtccaaagcaattagtatccttaggaccagaaaaatctgtggaaggtcaga

SEQ ID NO: 3594 - DNA, 201 bp, Homo sapiens
tgcacaaaatccagatatgtcgttctttaagatgctattcttgccagaatcagcaaggtggatacaaaggactcatggaaagaactctctgaactctgggyaaggccccagtccaaagcaattagtatccttaggaccagaaaaatctgtggaaggtcagaatttcttgtctgagaaaaacaaagtggtagtaggaaaggg

SEQ ID NO: 3595 - DNA, 201 bp, Homo sapiens
attaatccaagagaatgtagttttgcctcagatacatacagtgactggcactaagaatttcatgaagaaccttttcttactgagcactaggcaaaatgtakaaggttcatatgagggggcatatgctccagtacttcaagattttaggtcattaaatgattcaacaaatagaacaaagaaacacacagctcatttctcaaa

SEQ ID NO: 3596 - DNA, 201 bp, Homo sapiens
ctgagagtagcaacagaaagctctgcaaagactccctccaagctattggatcctcttgcttgggataaccactatggtactcagataccaaaagaagagtrgaaatcccaagagaagtcaccagaaaaaacagcttttaagaaaaaggataccattttgtccctgaacgcttgtgaaagcaatcatgcaatagcagcaata

SEQ ID NO: 3597 - DNA, 201 bp, Homo sapiens
ctggaaagcttctgagggagctgaatatgatgatcagaccagtcaaagggagaaagaagatgataaagtcttccctggtggaagccatacatatgtctggyaggtcctgaaagagaatggtccaatggcctctgacccactgtgccttacctactcatatctttctcatgtggacctggtaaaagacttgaattcaggcct

SEQ ID NO: 3598 - DNA, 201 bp, Homo sapiens
tcttgcgacagagtcctactccacatgggctatccttatctgatctccaagaagccaaatatgagactttttctgatgatccatcacctggagcaatagamagtaataacagcctgtctgaaatgacacacttcaggccacagctccatcacagtggggacatggtatttacccctgagtcaggcctccaattaagattaa

SEQ ID NO: 3599 - DNA, 201 bp, Homo sapiens
aaagcttctgagggagctgaatatgatgatcagaccagtcaaagggagaaagaagatgataaagtcttccctggtggaagccatacatatgtctggcaggycctgaaagagaatggtccaatggcctctgacccactgtgccttacctactcatatctttctcatgtggacctggtaaaagacttgaattcaggcctcatt

SEQ ID NO: 3600 - DNA, 201 bp, Homo sapiens
gagctgaatatgatgatcagaccagtcaaagggagaaagaagatgataaagtcttccctggtggaagccatacatatgtctggcaggtcctgaaagagaawggtccaatggcctctgacccactgtgccttacctactcatatctttctcatgtggacctggtaaaagacttgaattcaggcctcattggagccctactag

SEQ ID NO: 3601 - DNA, 201 bp, Homo sapiens
gctgaatatgatgatcagaccagtcaaagggagaaagaagatgataaagtcttccctggtggaagccatacatatgtctggcaggtcctgaaagagaatgdtccaatggcctctgacccactgtgccttacctactcatatctttctcatgtggacctggtaaaagacttgaattcaggcctcattggagccctactagta

SEQ ID NO: 3602 - DNA, 201 bp, Homo sapiens
tgaatatgatgatcagaccagtcaaagggagaaagaagatgataaagtcttccctggtggaagccatacatatgtctggcaggtcctgaaagagaatggtycaatggcctctgacccactgtgccttacctactcatatctttctcatgtggacctggtaaaagacttgaattcaggcctcattggagccctactagtatg

SEQ ID NO: 3603 - DNA, 201 bp, Homo sapiens
ccccagagttgggtgcaccagattgccctgaggatggaggttctgggctgcgaggcacaggacctctactgagggtggccactgcagcacctgccactgcygtcacctctccctcctcagctccagggcagtgtccctccctggcttgccttctacctttgtgctaaatcctagcagacactgccttgaagcctcctgaat

SEQ ID NO: 3604 - DNA, 201 bp, Homo sapiens
aaagggagaaagaagatgataaagtcttccctggtggaagccatacatatgtctggcaggtcctgaaagagaatggtccaatggcctctgacccactgtgscttacctactcatatctttctcatgtggacctggtaaaagacttgaattcaggcctcattggagccctactagtatgtagagaagggagtctggccaagg

SEQ ID NO: 3605 - DNA, 201 bp, Homo sapiens
aagaagatgataaagtcttccctggtggaagccatacatatgtctggcaggtcctgaaagagaatggtccaatggcctctgacccactgtgccttacctamtcatatctttctcatgtggacctggtaaaagacttgaattcaggcctcattggagccctactagtatgtagagaagggagtctggccaaggaaaagacac

SEQ ID NO: 3606 - DNA, 201 bp, Homo sapiens
agaagatgataaagtcttccctggtggaagccatacatatgtctggcaggtcctgaaagagaatggtccaatggcctctgacccactgtgccttacctacycatatctttctcatgtggacctggtaaaagacttgaattcaggcctcattggagccctactagtatgtagagaagggagtctggccaaggaaaagacaca

SEQ ID NO: 3607 - DNA, 201 bp, Homo sapiens
agtcatgcaaatagagctctccacctgcttctttctgtgccttttgcgattctgctttagtgccaccagaagatactacctgggtgcagtggaactgtcakgggactatatgcaaagtgatctcggtgagctgcctgtggacgcaagatttcctcctagagtgccaaaatcttttccattcaacacctcagtcgtgtacaa

SEQ ID NO: 3608 - DNA, 201 bp, Homo sapiens
taaagtcttccctggtggaagccatacatatgtctggcaggtcctgaaagagaatggtccaatggcctctgacccactgtgccttacctactcatatcttyctcatgtggacctggtaaaagacttgaattcaggcctcattggagccctactagtatgtagagaagggagtctggccaaggaaaagacacagaccttgca

SEQ ID NO: 3609 - DNA, 201 bp, Homo sapiens
cttccctggtggaagccatacatatgtctggcaggtcctgaaagagaatggtccaatggcctctgacccactgtgccttacctactcatatctttctcatrtggacctggtaaaagacttgaattcaggcctcattggagccctactagtatgtagagaagggagtctggccaaggaaaagacacagaccttgcacaaatt

SEQ ID NO: 3610 - DNA, 201 bp, Homo sapiens
tattttagagaagaattaaccttttgcttctccagttgaacatttgtagcaataagtcatgcaaatagagctctccacctgcttctttctgtgccttttgygattctgctttagtgccaccagaagatactacctgggtgcagtggaactgtcatgggactatatgcaaagtgatctcggtgagctgcctgtggacgcaag

SEQ ID NO: 3611 - DNA, 201 bp, Homo sapiens
atcagaaattttacttttttcccctcctgggagctaaagatattttagagaagaattaaccttttgcttctccagttgaacatttgtagcaataagtcatrcaaatagagctctccacctgcttctttctgtgccttttgcgattctgctttagtgccaccagaagatactacctgggtgcagtggaactgtcatgggact

SEQ ID NO: 3612 - DNA, 201 bp, Homo sapiens
aacaatggccctcagcggattggtaggaagtacaaaaaagtccgatttatggcatacacagatgaaacctttaagactcgtgaagctattcagcatgaatsaggaatcttgggacctttactttatggggaagttggagacacactgttgattatatttaagaatcaagcaagcagaccatataacatctaccctcacgga

SEQ ID NO: 3613 - DNA, 201 bp, Homo sapiens
aaagagtggctgcaagtggacttccagaagacaatgaaagtcacaggagtaactactcagggagtaaaatctctgcttaccagcatgtatgtgaaggagtkcctcatctccagcagtcaagatggccatcagtggactctcttttttcagaatggcaaagtaaaggtttttcagggaaatcaagactccttcacacctgtg

SEQ ID NO: 3614 - DNA, 201 bp, Homo sapiens
gctgctgaagaggaggactgggactatgctcccttagtcctcgcccccgatgacagaagttataaaagtcaatatttgaacaatggccctcagcggattgdtaggaagtacaaaaaagtccgatttatggcatacacagatgaaacctttaagactcgtgaagctattcagcatgaatcaggaatcttgggacctttactt

SEQ ID NO: 3615 - DNA, 201 bp, Homo sapiens
tgtatcctactggaaagcttctgagggagctgaatatgatgatcagaccagtcaaagggagaaagaagatgataaagtcttccctggtggaagccatacayatgtctggcaggtcctgaaagagaatggtccaatggcctctgacccactgtgccttacctactcatatctttctcatgtggacctggtaaaagacttgaa

SEQ ID NO: 3616 - DNA, 201 bp, Homo sapiens
gtggtcaggtttgatgatgacaactctccttcctttatccaaattcgctcagttgccaagaagcatcctaaaacttgggtacattacattgctgctgaagrggaggactgggactatgctcccttagtcctcgcccccgatgacagaagttataaaagtcaatatttgaacaatggccctcagcggattggtaggaagtac

SEQ ID NO: 3617 - DNA, 201 bp, Homo sapiens
tctgaaatggatgtggtcaggtttgatgatgacaactctccttcctttatccaaattcgctcagttgccaagaagcatcctaaaacttgggtacattacaktgctgctgaagaggaggactgggactatgctcccttagtcctcgcccccgatgacagaagttataaaagtcaatatttgaacaatggccctcagcggatt

SEQ ID NO: 3618 - DNA, 201 bp, Homo sapiens
agaagttgaagataatatcatggtaactttcagaaatcaggcctctcgtccctattccttctattctagccttatttcttatgaggaagatcagaggcaakgagcagaacctagaaaaaactttgtcaagcctaatgaaaccaaaacttacttttggaaagtgcaacatcatatggcacccactaaagatgagtttgactg

SEQ ID NO: 3619 - DNA, 201 bp, Homo sapiens
cagaggcaaggagcagaacctagaaaaaactttgtcaagcctaatgaaaccaaaacttacttttggaaagtgcaacatcatatggcacccactaaagatgrgtttgactgcaaagcctgggcttatttctctgatgttgacctggaaaaagatgtgcactcaggcctgattggaccccttctggtctgccacactaacaca

SEQ ID NO: 3620 - DNA, 201 bp, Homo sapiens
ttatttctctgatgttgacctggaaaaagatgtgcactcaggcctgattggaccccttctggtctgccacactaacacactgaaccctgctcatgggagayaagtgacagtacaggaatttgctctgtttttcaccatctttgatgagaccaaaagctggtacttcactgaaaatatggaaagaaactgcagggctccctg

SEQ ID NO: 3621 - DNA, 201 bp, Homo sapiens
ccttctggtctgccacactaacacactgaaccctgctcatgggagacaagtgacagtacaggaatttgctctgtttttcaccatctttgatgagaccaaawgctggtacttcactgaaaatatggaaagaaactgcagggctccctgcaatatccagatggaagatcccacttttaaagagaattatcgcttccatgcaat

SEQ ID NO: 3622 - DNA, 201 bp, Homo sapiens
ttctggtctgccacactaacacactgaaccctgctcatgggagacaagtgacagtacaggaatttgctctgtttttcaccatctttgatgagaccaaaagstggtacttcactgaaaatatggaaagaaactgcagggctccctgcaatatccagatggaagatcccacttttaaagagaattatcgcttccatgcaatca

SEQ ID NO: 3623 - DNA, 201 bp, Homo sapiens
aagtgacagtacaggaatttgctctgtttttcaccatctttgatgagaccaaaagctggtacttcactgaaaatatggaaagaaactgcagggctccctgvaatatccagatggaagatcccacttttaaagagaattatcgcttccatgcaatcaatggctacataatggatacactacctggcttagtaatggctcagg

SEQ ID NO: 3624 - DNA, 201 bp, Homo sapiens
acttttaaagagaattatcgcttccatgcaatcaatggctacataatggatacactacctggcttagtaatggctcaggatcaaaggattcgatggtatcygctcagcatgggcagcaatgaaaacatccattctattcatttcagtggacatgtgttcactgtacgaaaaaaagaggagtataaaatggcactgtacaat

SEQ ID NO: 3625 - DNA, 201 bp, Homo sapiens
tcgcagcactcttcgcatggagttgatgggctgtgatttaaatagttgcagcatgccattgggaatggagagtaaagcaatatcagatgcacagattactscttcatcctactttaccaatatgtttgccacctggtctccttcaaaagctcgacttcacctccaagggaggagtaatgcctggagacctcaggtgaataa

SEQ ID NO: 3626 - DNA, 201 bp, Homo sapiens
cctccaagggaggagtaatgcctggagacctcaggtgaataatccaaaagagtggctgcaagtggacttccagaagacaatgaaagtcacaggagtaactrctcagggagtaaaatctctgcttaccagcatgtatgtgaaggagttcctcatctccagcagtcaagatggccatcagtggactctcttttttcagaatgg

SEQ ID NO: 3627 - DNA, 201 bp, Homo sapiens
cttttttcagaatggcaaagtaaaggtttttcagggaaatcaagactccttcacacctgtggtgaactctctagacccaccgttactgactcgctaccttbgaattcacccccagagttgggtgcaccagattgccctgaggatggaggttctgggctgcgaggcacaggacctctactgagggtggccactgcagcacct

SEQ ID NO: 3628 - DNA, 201 bp, Homo sapiens
gggctgtgatttaaatagttgcagcatgccattgggaatggagagtaaagcaatatcagatgcacagattactgcttcatcctactttaccaatatgtttsccacctggtctccttcaaaagctcgacttcacctccaagggaggagtaatgcctggagacctcaggtgaataatccaaaagagtggctgcaagtggactt

SEQ ID NO: 3629 - DNA, 201 bp, Homo sapiens
tactgattctgaaatggatgtggtcaggtttgatgatgacaactctccttcctttatccaaattcgctcagttgccaagaagcatcctaaaacttgggtasattacattgctgctgaagaggaggactgggactatgctcccttagtcctcgcccccgatgacagaagttataaaagtcaatatttgaacaatggccctca

SEQ ID NO: 3630 - DNA, 201 bp, Homo sapiens
tgatcttactgattctgaaatggatgtggtcaggtttgatgatgacaactctccttcctttatccaaattcgctcagttgccaagaagcatcctaaaactkgggtacattacattgctgctgaagaggaggactgggactatgctcccttagtcctcgcccccgatgacagaagttataaaagtcaatatttgaacaatgg

SEQ ID NO: 3631 - DNA, 201 bp, Homo sapiens
atgcaaagtgatctcggtgagctgcctgtggacgcaagatttcctcctagagtgccaaaatcttttccattcaacacctcagtcgtgtacaaaaagactcygtttgtagaattcacggatcaccttttcaacatcgctaagccaaggccaccctggatgggtctgctaggtcctaccatccaggctgaggtttatgataca

SEQ ID NO: 3632 - DNA, 201 bp, Homo sapiens
tgagctgcctgtggacgcaagatttcctcctagagtgccaaaatcttttccattcaacacctcagtcgtgtacaaaaagactctgtttgtagaattcacgkatcaccttttcaacatcgctaagccaaggccaccctggatgggtctgctaggtcctaccatccaggctgaggtttatgatacagtggtcattacacttaa

SEQ ID NO: 3633 - DNA, 201 bp, Homo sapiens
ccttggacagtttctactgttttgtcatatctcttcccaccaacatgatggcatggaagcttatgtcaaagtagacagctgtccagaggaaccccaactaygaatgaaaaataatgaagaagcggaagactatgatgatgatcttactgattctgaaatggatgtggtcaggtttgatgatgacaactctccttcctttat

SEQ ID NO: 3634 - DNA, 201 bp, Homo sapiens
atcgcttccatgcaatcaatggctacataatggatacactacctggcttagtaatggctcaggatcaaaggattcgatggtatctgctcagcatgggcagmaatgaaaacatccattctattcatttcagtggacatgtgttcactgtacgaaaaaaagaggagtataaaatggcactgtacaatctctatccaggtgttt

SEQ ID NO: 3635 - DNA, 201 bp, Homo sapiens
acctggcttagtaatggctcaggatcaaaggattcgatggtatctgctcagcatgggcagcaatgaaaacatccattctattcatttcagtggacatgtgwtcactgtacgaaaaaaagaggagtataaaatggcactgtacaatctctatccaggtgtttttgagacagtggaaatgttaccatccaaagctggaatttg

SEQ ID NO: 3636 - DNA, 201 bp, Homo sapiens
tcactgtacgaaaaaaagaggagtataaaatggcactgtacaatctctatccaggtgtttttgagacagtggaaatgttaccatccaaagctggaatttgkcgggtggaatgccttattggcgagcatctacatgctgggatgagcacactttttctggtgtacagcaataagtgtcagactcccctgggaatggcttctg

SEQ ID NO: 3637 - DNA, 201 bp, Homo sapiens
tttgcttctccagttgaacatttgtagcaataagtcatgcaaatagagctctccacctgcttctttctgtgccttttgcgattctgctttagtgccaccasaagatactacctgggtgcagtggaactgtcatgggactatatgcaaagtgatctcggtgagctgcctgtggacgcaagatttcctcctagagtgccaaaa

SEQ ID NO: 3638 - DNA, 201 bp, Homo sapiens
ccagttgaacatttgtagcaataagtcatgcaaatagagctctccacctgcttctttctgtgccttttgcgattctgctttagtgccaccagaagatactrcctgggtgcagtggaactgtcatgggactatatgcaaagtgatctcggtgagctgcctgtggacgcaagatttcctcctagagtgccaaaatcttttcca

SEQ ID NO: 3639 - DNA, 201 bp, Homo sapiens
ggaaccttaatggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagttgcagcatgccattgggaatggagagtaaagcaatatcagat

SEQ ID NO: 3640 - DNA, 201 bp, Homo sapiens
ggactatatgcaaagtgatctcggtgagctgcctgtggacgcaagatttcctcctagagtgccaaaatcttttccattcaacacctcagtcgtgtacaaaragactctgtttgtagaattcacggatcaccttttcaacatcgctaagccaaggccaccctggatgggtctgctaggtcctaccatccaggctgaggttta

SEQ ID NO: 3641 - DNA, 201 bp, Homo sapiens
catgccattgggaatggagagtaaagcaatatcagatgcacagattactgcttcatcctactttaccaatatgtttgccacctggtctccttcaaaagctbgacttcacctccaagggaggagtaatgcctggagacctcaggtgaataatccaaaagagtggctgcaagtggacttccagaagacaatgaaagtcacagg

SEQ ID NO: 3642 - DNA, 201 bp, Homo sapiens
aaaagagtggctgcaagtggacttccagaagacaatgaaagtcacaggagtaactactcagggagtaaaatctctgcttaccagcatgtatgtgaaggagwtcctcatctccagcagtcaagatggccatcagtggactctcttttttcagaatggcaaagtaaaggtttttcagggaaatcaagactccttcacacctgt

SEQ ID NO: 3643 - DNA, 201 bp, Homo sapiens
tccttcaaaagctcgacttcacctccaagggaggagtaatgcctggagacctcaggtgaataatccaaaagagtggctgcaagtggacttccagaagacartgaaagtcacaggagtaactactcagggagtaaaatctctgcttaccagcatgtatgtgaaggagttcctcatctccagcagtcaagatggccatcagtg

SEQ ID NO: 3644 - DNA, 201 bp, Homo sapiens
ttaccaatatgtttgccacctggtctccttcaaaagctcgacttcacctccaagggaggagtaatgcctggagacctcaggtgaataatccaaaagagtgkctgcaagtggacttccagaagacaatgaaagtcacaggagtaactactcagggagtaaaatctctgcttaccagcatgtatgtgaaggagttcctcatct

SEQ ID NO: 3645 - DNA, 201 bp, Homo sapiens
agcattcgcagcactcttcgcatggagttgatgggctgtgatttaaatagttgcagcatgccattgggaatggagagtaaagcaatatcagatgcacagawtactgcttcatcctactttaccaatatgtttgccacctggtctccttcaaaagctcgacttcacctccaagggaggagtaatgcctggagacctcaggtg

SEQ ID NO: 3646 - DNA, 201 bp, Homo sapiens
tgcaaatagagctctccacctgcttctttctgtgccttttgcgattctgctttagtgccaccagaagatactacctgggtgcagtggaactgtcatgggaytatatgcaaagtgatctcggtgagctgcctgtggacgcaagatttcctcctagagtgccaaaatcttttccattcaacacctcagtcgtgtacaaaaaga

SEQ ID NO: 3647 - DNA, 201 bp, Homo sapiens
gtcatgcaaatagagctctccacctgcttctttctgtgccttttgcgattctgctttagtgccaccagaagatactacctgggtgcagtggaactgtcatrggactatatgcaaagtgatctcggtgagctgcctgtggacgcaagatttcctcctagagtgccaaaatcttttccattcaacacctcagtcgtgtacaaa

SEQ ID NO: 3648 - DNA, 201 bp, Homo sapiens
ttcaacatcgctaagccaaggccaccctggatgggtctgctaggtcctaccatccaggctgaggtttatgatacagtggtcattacacttaagaacatggyttcccatcctgtcagtcttcatgctgttggtgtatcctactggaaagcttctgagggagctgaatatgatgatcagaccagtcaaagggagaaagaagat

SEQ ID NO: 3649 - DNA, 201 bp, Homo sapiens
catacatatgtctggcaggtcctgaaagagaatggtccaatggcctctgacccactgtgccttacctactcatatctttctcatgtggacctggtaaaagrcttgaattcaggcctcattggagccctactagtatgtagagaagggagtctggccaaggaaaagacacagaccttgcacaaatttatactactttttgct

SEQ ID NO: 3650 - DNA, 201 bp, Homo sapiens
gcacacagtcaatggttatgtaaacaggtctctgccaggtctgattggatgccacaggaaatcagtctattggcatgtgattggaatgggcaccactcctdaagtgcactcaatattcctcgaaggtcacacatttcttgtgaggaaccatcgccaggcgtccttggaaatctcgccaataactttccttactgctcaaac

SEQ ID NO: 3651 - DNA, 201 bp, Homo sapiens
tcttcccaccaacatgatggcatggaagcttatgtcaaagtagacagctgtccagaggaaccccaactacgaatgaaaaataatgaagaagcggaagactrtgatgatgatcttactgattctgaaatggatgtggtcaggtttgatgatgacaactctccttcctttatccaaattcgctcagttgccaagaagcatcct

SEQ ID NO: 3652 - DNA, 201 bp, Homo sapiens
acagattactgcttcatcctactttaccaatatgtttgccacctggtctccttcaaaagctcgacttcacctccaagggaggagtaatgcctggagacctyaggtgaataatccaaaagagtggctgcaagtggacttccagaagacaatgaaagtcacaggagtaactactcagggagtaaaatctctgcttaccagcat

SEQ ID NO: 3653 - DNA, 201 bp, Homo sapiens
tacattgctgctgaagaggaggactgggactatgctcccttagtcctcgcccccgatgacagaagttataaaagtcaatatttgaacaatggccctcagcsgattggtaggaagtacaaaaaagtccgatttatggcatacacagatgaaacctttaagactcgtgaagctattcagcatgaatcaggaatcttgggacct

SEQ ID NO: 3654 - DNA, 201 bp, Homo sapiens
cattgctgctgaagaggaggactgggactatgctcccttagtcctcgcccccgatgacagaagttataaaagtcaatatttgaacaatggccctcagcggwttggtaggaagtacaaaaaagtccgatttatggcatacacagatgaaacctttaagactcgtgaagctattcagcatgaatcaggaatcttgggaccttt

SEQ ID NO: 3655 - DNA, 201 bp, Homo sapiens
tccctccaagctattggatcctcttgcttgggataaccactatggtactcagataccaaaagaagagtggaaatcccaagagaagtcaccagaaaaaacakcttttaagaaaaaggataccattttgtccctgaacgcttgtgaaagcaatcatgcaatagcagcaataaatgagggacaaaataagcccgaaatagaagt

SEQ ID NO: 3656 - DNA, 201 bp, Homo sapiens
gctcgatacatccgtttgcacccaactcattatagcattcgcagcactcttcgcatggagttgatgggctgtgatttaaatagttgcagcatgccattggkaatggagagtaaagcaatatcagatgcacagattactgcttcatcctactttaccaatatgtttgccacctggtctccttcaaaagctcgacttcacctc

SEQ ID NO: 3657 - DNA, 201 bp, Homo sapiens
tctgggataaaacacaatatttttaaccctccaattattgctcgatacatccgtttgcacccaactcattatagcattcgcagcactcttcgcatggagtbgatgggctgtgatttaaatagttgcagcatgccattgggaatggagagtaaagcaatatcagatgcacagattactgcttcatcctactttaccaatatg

SEQ ID NO: 3658 - DNA, 201 bp, Homo sapiens
ggcaaagtaaaggtttttcagggaaatcaagactccttcacacctgtggtgaactctctagacccaccgttactgactcgctaccttcgaattcacccccmgagttgggtgcaccagattgccctgaggatggaggttctgggctgcgaggcacaggacctctactgagggtggccactgcagcacctgccactgccgtca

SEQ ID NO: 3659 - DNA, 201 bp, Homo sapiens
ctcccagaattcaagacaccctagcactaggcaaaagcaatttaatgccaccacaattccagaaaatgacatagagaagactgacccttggtttgcacacrgaacacctatgcctaaaatacaaaatgtctcctctagtgatttgttgatgctcttgcgacagagtcctactccacatgggctatccttatctgatctcca

SEQ ID NO: 3660 - DNA, 201 bp, Homo sapiens
aggctaacttacagaaatgaataagttgttttgttttatagcccggtagaggagttaaccccaaaggtgatatggttttatttcctgttatgtttaacttrataatcttattttggcattcttttcccattgactatatacatctctatttctcaaatgttcatggaactagctcttttattttcctgctggtttcttcag

SEQ ID NO: 3661 - DNA, 201 bp, Homo sapiens
tatgctggagtattttctaataatcctgcttgacccttatctgacctctttggaaactataacatagctgtcacagtatagtcacaatccacaaatgatgmaggtgcaaatggtttatagccctgtgaagttcttaaagtttagaggctaacttacagaaatgaataagttgttttgttttatagcccggtagaggagtta

SEQ ID NO: 3662 - DNA, 201 bp, Homo sapiens
tccacccccataagattgtgaagggtttactgctccttccatctgcctgaccccttcactatgactacacagaatctcctgatagtaaagggggctggagrcaaggataagttatagagcagttggaggaagcatccaaagattgcaacccagggcaaatggaaaacaggagatcctaatatgaaagaaaaatggatccca

SEQ ID NO: 3663 - DNA, 201 bp, Homo sapiens
cgcccccgatgacagaagttataaaagtcaatatttgaacaatggccctcagcggattggtaggaagtacaaaaaagtccgatttatggcatacacagatkaaacctttaagactcgtgaagctattcagcatgaatcaggaatcttgggacctttactttatggggaagttggagacacactgttgattatatttaagaa

SEQ ID NO: 3664 - DNA, 201 bp, Homo sapiens
agaaaaaacagcttttaagaaaaaggataccattttgtccctgaacgcttgtgaaagcaatcatgcaatagcagcaataaatgagggacaaaataagccckaaatagaagtcacctgggcaaagcaaggtaggactgaaaggctgtgctctcaaaacccaccagtcttgaaacgccatcaacgggaaataactcgtactac

SEQ ID NO: 3665 - DNA, 201 bp, Homo sapiens
gatgacagaagttataaaagtcaatatttgaacaatggccctcagcggattggtaggaagtacaaaaaagtccgatttatggcatacacagatgaaacctktaagactcgtgaagctattcagcatgaatcaggaatcttgggacctttactttatggggaagttggagacacactgttgattatatttaagaatcaagca

SEQ ID NO: 3666 - DNA, 201 bp, Homo sapiens
agaaaaaggataccattttgtccctgaacgcttgtgaaagcaatcatgcaatagcagcaataaatgagggacaaaataagcccgaaatagaagtcacctgrgcaaagcaaggtaggactgaaaggctgtgctctcaaaacccaccagtcttgaaacgccatcaacgggaaataactcgtactactcttcagtcagatcaag

SEQ ID NO: 3667 - DNA, 201 bp, Homo sapiens
gaatctgtagatcaaagaggaaaccagataatgtcagacaagaggaatgtcatcctgttttctgtatttgatgagaaccgaagctggtacctcacagagawtatacaacgctttctccccaatccagctggagtgcagcttgaggatccagagttccaagcctccaacatcatgcacagcatcaatggctatgtttttgat

SEQ ID NO: 3668 - DNA, 201 bp, Homo sapiens
catcaacgggaaataactcgtactactcttcagtcagatcaagaggaaattgactatgatgataccatatcagttgaaatgaagaaggaagattttgacayttatgatgaggatgaaaatcagagcccccgcagctttcaaaagaaaacacgacactattttattgctgcagtggagaggctctgggattatgggatgagt

SEQ ID NO: 3669 - DNA, 201 bp, Homo sapiens
cagctggagtgcagcttgaggatccagagttccaagcctccaacatcatgcacagcatcaatggctatgtttttgatagtttgcagttgtcagtttgtttscatgaggtggcatactggtacattctaagcattggagcacagactgacttcctttctgtcttcttctctggatataccttcaaacacaaaatggtctatg

SEQ ID NO: 3670 - DNA, 201 bp, Homo sapiens
caacgggaaataactcgtactactcttcagtcagatcaagaggaaattgactatgatgataccatatcagttgaaatgaagaaggaagattttgacatttdtgatgaggatgaaaatcagagcccccgcagctttcaaaagaaaacacgacactattttattgctgcagtggagaggctctgggattatgggatgagtagc

SEQ ID NO: 3671 - DNA, 201 bp, Homo sapiens
tttgtttgcatgaggtggcatactggtacattctaagcattggagcacagactgacttcctttctgtcttcttctctggatataccttcaaacacaaaatsgtctatgaagacacactcaccctattcccattctcaggagaaactgtcttcatgtcgatggaaaacccaggtctatggattctggggtgccacaactcag

SEQ ID NO: 3672 - DNA, 201 bp, Homo sapiens
tactactcttcagtcagatcaagaggaaattgactatgatgataccatatcagttgaaatgaagaaggaagattttgacatttatgatgaggatgaaaatyagagcccccgcagctttcaaaagaaaacacgacactattttattgctgcagtggagaggctctgggattatgggatgagtagctccccacatgttctaag

SEQ ID NO: 3673 - DNA, 201 bp, Homo sapiens
tcagtcagatcaagaggaaattgactatgatgataccatatcagttgaaatgaagaaggaagattttgacatttatgatgaggatgaaaatcagagccccygcagctttcaaaagaaaacacgacactattttattgctgcagtggagaggctctgggattatgggatgagtagctccccacatgttctaagaaacagggc

SEQ ID NO: 3674 - DNA, 201 bp, Homo sapiens
cagtcagatcaagaggaaattgactatgatgataccatatcagttgaaatgaagaaggaagattttgacatttatgatgaggatgaaaatcagagcccccrcagctttcaaaagaaaacacgacactattttattgctgcagtggagaggctctgggattatgggatgagtagctccccacatgttctaagaaacagggct

SEQ ID NO: 3675 - DNA, 201 bp, Homo sapiens
tgactatgatgataccatatcagttgaaatgaagaaggaagattttgacatttatgatgaggatgaaaatcagagcccccgcagctttcaaaagaaaacabgacactattttattgctgcagtggagaggctctgggattatgggatgagtagctccccacatgttctaagaaacagggctcagagtggcagtgtccctca

SEQ ID NO: 3676 - DNA, 201 bp, Homo sapiens
ccctcacggaatcactgatgtccgtcctttgtattcaaggagattaccaaaaggtgtaaaacatttgaaggattttccaattctgccaggagaaatattcraatataaatggacagtgactgtagaagatgggccaactaaatcagatcctcggtgcctgacccgctattactctagtttcgttaatatggagagagatct

SEQ ID NO: 3677 - DNA, 201 bp, Homo sapiens
tgaaatgaagaaggaagattttgacatttatgatgaggatgaaaatcagagcccccgcagctttcaaaagaaaacacgacactattttattgctgcagtgragaggctctgggattatgggatgagtagctccccacatgttctaagaaacagggctcagagtggcagtgtccctcagttcaagaaagttgttttccagga

SEQ ID NO: 3678 - DNA, 201 bp, Homo sapiens
gacttatcgaggaaattccactggaaccttaatggtcttctttggcaatgtggattcatctgggataaaacacaatatttttaaccctccaattattgctygatacatccgtttgcacccaactcattatagcattcgcagcactcttcgcatggagttgatgggctgtgatttaaatagttgcagcatgccattgggaat

SEQ ID NO: 3679 - DNA, 201 bp, Homo sapiens
ctcctcatctgctacaaagaatctgtagatcaaagaggaaaccagataatgtcagacaagaggaatgtcatcctgttttctgtatttgatgagaaccgaakctggtacctcacagagaatatacaacgctttctccccaatccagctggagtgcagcttgaggatccagagttccaagcctccaacatcatgcacagcatc

SEQ ID NO: 3680 - DNA, 201 bp, Homo sapiens
catcgctaagccaaggccaccctggatgggtctgctaggtcctaccatccaggctgaggtttatgatacagtggtcattacacttaagaacatggcttccyatcctgtcagtcttcatgctgttggtgtatcctactggaaagcttctgagggagctgaatatgatgatcagaccagtcaaagggagaaagaagatgataa

SEQ ID NO: 3681 - DNA, 201 bp, Homo sapiens
gtagaattcacggatcaccttttcaacatcgctaagccaaggccaccctggatgggtctgctaggtcctaccatccaggctgaggtttatgatacagtggwcattacacttaagaacatggcttcccatcctgtcagtcttcatgctgttggtgtatcctactggaaagcttctgagggagctgaatatgatgatcagacc

SEQ ID NO: 3682 - DNA, 201 bp, Homo sapiens
tcgggcctggcctaaaatgcacacagtcaatggttatgtaaacaggtctctgccaggtctgattggatgccacaggaaatcagtctattggcatgtgattrgaatgggcaccactcctgaagtgcactcaatattcctcgaaggtcacacatttcttgtgaggaaccatcgccaggcgtccttggaaatctcgccaataac

SEQ ID NO: 3683 - DNA, 201 bp, Homo sapiens
acagtcaatggttatgtaaacaggtctctgccaggtctgattggatgccacaggaaatcagtctattggcatgtgattggaatgggcaccactcctgaagkgcactcaatattcctcgaaggtcacacatttcttgtgaggaaccatcgccaggcgtccttggaaatctcgccaataactttccttactgctcaaacactc

SEQ ID NO: 3684 - DNA, 201 bp, Homo sapiens
aggaaattccactggaaccttaatggtcttctttggcaatgtggattcatctgggataaaacacaatatttttaaccctccaattattgctcgatacatcygtttgcacccaactcattatagcattcgcagcactcttcgcatggagttgatgggctgtgatttaaatagttgcagcatgccattgggaatggagagtaa

SEQ ID NO: 3685 - DNA, 201 bp, Homo sapiens
aaacaggtctctgccaggtctgattggatgccacaggaaatcagtctattggcatgtgattggaatgggcaccactcctgaagtgcactcaatattcctcdaaggtcacacatttcttgtgaggaaccatcgccaggcgtccttggaaatctcgccaataactttccttactgctcaaacactcttgatggaccttggaca

SEQ ID NO: 3686 - DNA, 201 bp, Homo sapiens
cttctttggcaatgtggattcatctgggataaaacacaatatttttaaccctccaattattgctcgatacatccgtttgcacccaactcattatagcattygcagcactcttcgcatggagttgatgggctgtgatttaaatagttgcagcatgccattgggaatggagagtaaagcaatatcagatgcacagattactgc

SEQ ID NO: 3687 - DNA, 201 bp, Homo sapiens
aacaggtctctgccaggtctgattggatgccacaggaaatcagtctattggcatgtgattggaatgggcaccactcctgaagtgcactcaatattcctcgraggtcacacatttcttgtgaggaaccatcgccaggcgtccttggaaatctcgccaataactttccttactgctcaaacactcttgatggaccttggacag

SEQ ID NO: 3688 - DNA, 201 bp, Homo sapiens
ttcgcatggagttgatgggctgtgatttaaatagttgcagcatgccattgggaatggagagtaaagcaatatcagatgcacagattactgcttcatcctaytttaccaatatgtttgccacctggtctccttcaaaagctcgacttcacctccaagggaggagtaatgcctggagacctcaggtgaataatccaaaagagt

SEQ ID NO: 3689 - DNA, 201 bp, Homo sapiens
atcaaagagaggttggctccctggggacaagtgccacaaattcagtcacatacaagaaagttgagaacactgttctcccgaaaccagacttgcccaaaacmtctggcaaagttgaattgcttccaaaagttcacatttatcagaaggacctattccctacggaaactagcaatgggtctcctggccatctggatctcgtgg

SEQ ID NO: 3690 - DNA, 201 bp, Homo sapiens
caagaaagcagtcatttcttacaaggagccaaaaaaaataacctttctttagccattctaaccttggagatgactggtgatcaaagagaggttggctcccyggggacaagtgccacaaattcagtcacatacaagaaagttgagaacactgttctcccgaaaccagacttgcccaaaacatctggcaaagttgaattgctt

SEQ ID NO: 3691 - DNA, 201 bp, Homo sapiens
tagaaggttcatatgagggggcatatgctccagtacttcaagattttaggtcattaaatgattcaacaaatagaacaaagaaacacacagctcatttctcmaaaaaaggggaggaagaaaacttggaaggcttgggaaatcaaaccaagcaaattgtagagaaatatgcatgcaccacaaggatatctcctaatacaagcc

SEQ ID NO: 3692 - DNA, 201 bp, Homo sapiens
cgaaaaaaagaggagtataaaatggcactgtacaatctctatccaggtgtttttgagacagtggaaatgttaccatccaaagctggaatttggcgggtggratgccttattggcgagcatctacatgctgggatgagcacactttttctggtgtacagcaataagtgtcagactcccctgggaatggcttctggacacatt

SEQ ID NO: 3693 - DNA, 201 bp, Homo sapiens
ctgccaggtctgattggatgccacaggaaatcagtctattggcatgtgattggaatgggcaccactcctgaagtgcactcaatattcctcgaaggtcacayatttcttgtgaggaaccatcgccaggcgtccttggaaatctcgccaataactttccttactgctcaaacactcttgatggaccttggacagtttctactg

SEQ ID NO: 3694 - DNA, 201 bp, Homo sapiens
ctgattggatgccacaggaaatcagtctattggcatgtgattggaatgggcaccactcctgaagtgcactcaatattcctcgaaggtcacacatttcttgygaggaaccatcgccaggcgtccttggaaatctcgccaataactttccttactgctcaaacactcttgatggaccttggacagtttctactgttttgtcat

SEQ ID NO: 3695 - DNA, 201 bp, Homo sapiens
ggatgccacaggaaatcagtctattggcatgtgattggaatgggcaccactcctgaagtgcactcaatattcctcgaaggtcacacatttcttgtgaggawccatcgccaggcgtccttggaaatctcgccaataactttccttactgctcaaacactcttgatggaccttggacagtttctactgttttgtcatatctct

SEQ ID NO: 3696 - DNA, 201 bp, Homo sapiens
ccacaggaaatcagtctattggcatgtgattggaatgggcaccactcctgaagtgcactcaatattcctcgaaggtcacacatttcttgtgaggaaccatygccaggcgtccttggaaatctcgccaataactttccttactgctcaaacactcttgatggaccttggacagtttctactgttttgtcatatctcttccca

SEQ ID NO: 3697 - DNA, 201 bp, Homo sapiens
cacaggaaatcagtctattggcatgtgattggaatgggcaccactcctgaagtgcactcaatattcctcgaaggtcacacatttcttgtgaggaaccatcdccaggcgtccttggaaatctcgccaataactttccttactgctcaaacactcttgatggaccttggacagtttctactgttttgtcatatctcttcccac

SEQ ID NO: 3698 - DNA, 201 bp, Homo sapiens
gaaatcagtctattggcatgtgattggaatgggcaccactcctgaagtgcactcaatattcctcgaaggtcacacatttcttgtgaggaaccatcgccagscgtccttggaaatctcgccaataactttccttactgctcaaacactcttgatggaccttggacagtttctactgttttgtcatatctcttcccaccaaca

SEQ ID NO: 3699 - DNA, 201 bp, Homo sapiens
aaatcagtctattggcatgtgattggaatgggcaccactcctgaagtgcactcaatattcctcgaaggtcacacatttcttgtgaggaaccatcgccaggmgtccttggaaatctcgccaataactttccttactgctcaaacactcttgatggaccttggacagtttctactgttttgtcatatctcttcccaccaacat

SEQ ID NO: 3700 - DNA, 201 bp, Homo sapiens
catgtgattggaatgggcaccactcctgaagtgcactcaatattcctcgaaggtcacacatttcttgtgaggaaccatcgccaggcgtccttggaaatctygccaataactttccttactgctcaaacactcttgatggaccttggacagtttctactgttttgtcatatctcttcccaccaacatgatggcatggaagct

SEQ ID NO: 3701 - DNA, 201 bp, Homo sapiens
tcttttccattcaacacctcagtcgtgtacaaaaagactctgtttgtagaattcacggatcaccttttcaacatcgctaagccaaggccaccctggatggrtctgctaggtcctaccatccaggctgaggtttatgatacagtggtcattacacttaagaacatggcttcccatcctgtcagtcttcatgctgttggtgta

SEQ ID NO: 3702 - DNA, 201 bp, Homo sapiens
atgggcaccactcctgaagtgcactcaatattcctcgaaggtcacacatttcttgtgaggaaccatcgccaggcgtccttggaaatctcgccaataacttyccttactgctcaaacactcttgatggaccttggacagtttctactgttttgtcatatctcttcccaccaacatgatggcatggaagcttatgtcaaagta

SEQ ID NO: 3703 - DNA, 201 bp, Homo sapiens
caggctgaggtttatgatacagtggtcattacacttaagaacatggcttcccatcctgtcagtcttcatgctgttggtgtatcctactggaaagcttctgwgggagctgaatatgatgatcagaccagtcaaagggagaaagaagatgataaagtcttccctggtggaagccatacatatgtctggcaggtcctgaaagag

SEQ ID NO: 3704 - DNA, 201 bp, Homo sapiens
actgtacgaaaaaaagaggagtataaaatggcactgtacaatctctatccaggtgtttttgagacagtggaaatgttaccatccaaagctggaatttggcsggtggaatgccttattggcgagcatctacatgctgggatgagcacactttttctggtgtacagcaataagtgtcagactcccctgggaatggcttctgga

SEQ ID NO: 3705 - DNA, 201 bp, Homo sapiens
caccactcctgaagtgcactcaatattcctcgaaggtcacacatttcttgtgaggaaccatcgccaggcgtccttggaaatctcgccaataactttccttrctgctcaaacactcttgatggaccttggacagtttctactgttttgtcatatctcttcccaccaacatgatggcatggaagcttatgtcaaagtagacag

SEQ ID NO: 3706 - DNA, 201 bp, Homo sapiens
ggctgaggtttatgatacagtggtcattacacttaagaacatggcttcccatcctgtcagtcttcatgctgttggtgtatcctactggaaagcttctgagsgagctgaatatgatgatcagaccagtcaaagggagaaagaagatgataaagtcttccctggtggaagccatacatatgtctggcaggtcctgaaagagaa

SEQ ID NO: 3707 - DNA, 201 bp, Homo sapiens
tttatgatacagtggtcattacacttaagaacatggcttcccatcctgtcagtcttcatgctgttggtgtatcctactggaaagcttctgagggagctgamtatgatgatcagaccagtcaaagggagaaagaagatgataaagtcttccctggtggaagccatacatatgtctggcaggtcctgaaagagaatggtccaa

SEQ ID NO: 3708 - DNA, 201 bp, Homo sapiens
tatgatacagtggtcattacacttaagaacatggcttcccatcctgtcagtcttcatgctgttggtgtatcctactggaaagcttctgagggagctgaatrtgatgatcagaccagtcaaagggagaaagaagatgataaagtcttccctggtggaagccatacatatgtctggcaggtcctgaaagagaatggtccaatg

SEQ ID NO: 3709 - DNA, 201 bp, Homo sapiens
acagtggtcattacacttaagaacatggcttcccatcctgtcagtcttcatgctgttggtgtatcctactggaaagcttctgagggagctgaatatgatgrtcagaccagtcaaagggagaaagaagatgataaagtcttccctggtggaagccatacatatgtctggcaggtcctgaaagagaatggtccaatggcctct

SEQ ID NO: 3710 - DNA, 201 bp, Homo sapiens
gtaatggctcaggatcaaaggattcgatggtatctgctcagcatgggcagcaatgaaaacatccattctattcatttcagtggacatgtgttcactgtacvaaaaaaagaggagtataaaatggcactgtacaatctctatccaggtgtttttgagacagtggaaatgttaccatccaaagctggaatttggcgggtggaa

SEQ ID NO: 3711 - DNA, 201 bp, Homo sapiens
aattatcgcttccatgcaatcaatggctacataatggatacactacctggcttagtaatggctcaggatcaaaggattcgatggtatctgctcagcatggrcagcaatgaaaacatccattctattcatttcagtggacatgtgttcactgtacgaaaaaaagaggagtataaaatggcactgtacaatctctatccaggt

SEQ ID NO: 3712 - DNA, 201 bp, Homo sapiens
gtctgccacactaacacactgaaccctgctcatgggagacaagtgacagtacaggaatttgctctgtttttcaccatctttgatgagaccaaaagctggtrcttcactgaaaatatggaaagaaactgcagggctccctgcaatatccagatggaagatcccacttttaaagagaattatcgcttccatgcaatcaatggc

SEQ ID NO: 3713 - DNA, 201 bp, Homo sapiens
tggactctcttttttcagaatggcaaagtaaaggtttttcagggaaatcaagactccttcacacctgtggtgaactctctagacccaccgttactgactcrctaccttcgaattcacccccagagttgggtgcaccagattgccctgaggatggaggttctgggctgcgaggcacaggacctctactgagggtggccactg

SEQ ID NO: 3714 - DNA, 201 bp, Homo sapiens
cctgtcagtcttcatgctgttggtgtatcctactggaaagcttctgagggagctgaatatgatgatcagaccagtcaaagggagaaagaagatgataaagwcttccctggtggaagccatacatatgtctggcaggtcctgaaagagaatggtccaatggcctctgacccactgtgccttacctactcatatctttctcat

SEQ ID NO: 3715 - DNA, 201 bp, Homo sapiens
gaggaggactgggactatgctcccttagtcctcgcccccgatgacagaagttataaaagtcaatatttgaacaatggccctcagcggattggtaggaagtrcaaaaaagtccgatttatggcatacacagatgaaacctttaagactcgtgaagctattcagcatgaatcaggaatcttgggacctttactttatggggaa

SEQ ID NO: 3716 - DNA, 201 bp, Homo sapiens
aatggccctcagcggattggtaggaagtacaaaaaagtccgatttatggcatacacagatgaaacctttaagactcgtgaagctattcagcatgaatcagraatcttgggacctttactttatggggaagttggagacacactgttgattatatttaagaatcaagcaagcagaccatataacatctaccctcacggaatc

SEQ ID NO: 3717 - DNA, 201 bp, Homo sapiens
accactcctgaagtgcactcaatattcctcgaaggtcacacatttcttgtgaggaaccatcgccaggcgtccttggaaatctcgccaataactttccttaytgctcaaacactcttgatggaccttggacagtttctactgttttgtcatatctcttcccaccaacatgatggcatggaagcttatgtcaaagtagacagc

SEQ ID NO: 3718 - DNA, 201 bp, Homo sapiens
actcctgaagtgcactcaatattcctcgaaggtcacacatttcttgtgaggaaccatcgccaggcgtccttggaaatctcgccaataactttccttactgytcaaacactcttgatggaccttggacagtttctactgttttgtcatatctcttcccaccaacatgatggcatggaagcttatgtcaaagtagacagctgt

SEQ ID NO: 3719 - DNA, 201 bp, Homo sapiens
tacagtggtcattacacttaagaacatggcttcccatcctgtcagtcttcatgctgttggtgtatcctactggaaagcttctgagggagctgaatatgatkatcagaccagtcaaagggagaaagaagatgataaagtcttccctggtggaagccatacatatgtctggcaggtcctgaaagagaatggtccaatggcctc

SEQ ID NO: 3720 - DNA, 201 bp, Homo sapiens
aatctcgccaataactttccttactgctcaaacactcttgatggaccttggacagtttctactgttttgtcatatctcttcccaccaacatgatggcatgraagcttatgtcaaagtagacagctgtccagaggaaccccaactacgaatgaaaaataatgaagaagcggaagactatgatgatgatcttactgattctga

SEQ ID NO: 3721 - DNA, 201 bp, Homo sapiens
agtggtcattacacttaagaacatggcttcccatcctgtcagtcttcatgctgttggtgtatcctactggaaagcttctgagggagctgaatatgatgatyagaccagtcaaagggagaaagaagatgataaagtcttccctggtggaagccatacatatgtctggcaggtcctgaaagagaatggtccaatggcctctga

SEQ ID NO: 3722 - DNA, 201 bp, Homo sapiens
gatggccatcagtggactctcttttttcagaatggcaaagtaaaggtttttcagggaaatcaagactccttcacacctgtggtgaactctctagacccacygttactgactcgctaccttcgaattcacccccagagttgggtgcaccagattgccctgaggatggaggttctgggctgcgaggcacaggacctctactga

SEQ ID NO: 3723 - DNA, 201 bp, Homo sapiens
gtcattacacttaagaacatggcttcccatcctgtcagtcttcatgctgttggtgtatcctactggaaagcttctgagggagctgaatatgatgatcagaycagtcaaagggagaaagaagatgataaagtcttccctggtggaagccatacatatgtctggcaggtcctgaaagagaatggtccaatggcctctgaccca

SEQ ID NO: 3724 - DNA, 201 bp, Homo sapiens
agatggccatcagtggactctcttttttcagaatggcaaagtaaaggtttttcagggaaatcaagactccttcacacctgtggtgaactctctagacccaycgttactgactcgctaccttcgaattcacccccagagttgggtgcaccagattgccctgaggatggaggttctgggctgcgaggcacaggacctctactg

SEQ ID NO: 3725 - DNA, 201 bp, Homo sapiens
gtaaaagacttgaattcaggcctcattggagccctactagtatgtagagaagggagtctggccaaggaaaagacacagaccttgcacaaatttatactacwttttgctgtatttgatgaagggaaaagttggcactcagaaacaaagaactccttgatgcaggatagggatgctgcatctgctcgggcctggcctaaaatg

SEQ ID NO: 3726 - DNA, 201 bp, Homo sapiens
taaccttggagatgactggtgatcaaagagaggttggctccctggggacaagtgccacaaattcagtcacatacaagaaagttgagaacactgttctcccraaaccagacttgcccaaaacatctggcaaagttgaattgcttccaaaagttcacatttatcagaaggacctattccctacggaaactagcaatgggtctc

SEQ ID NO: 3727 - DNA, 201 bp, Homo sapiens
gacttgaattcaggcctcattggagccctactagtatgtagagaagggagtctggccaaggaaaagacacagaccttgcacaaatttatactactttttgmtgtatttgatgaagggaaaagttggcactcagaaacaaagaactccttgatgcaggatagggatgctgcatctgctcgggcctggcctaaaatgcacaca

SEQ ID NO: 3728 - DNA, 201 bp, Homo sapiens
aaataatgaagaagcggaagactatgatgatgatcttactgattctgaaatggatgtggtcaggtttgatgatgacaactctccttcctttatccaaattygctcagttgccaagaagcatcctaaaacttgggtacattacattgctgctgaagaggaggactgggactatgctcccttagtcctcgcccccgatgacag

SEQ ID NO: 3729 - DNA, 201 bp, Homo sapiens
agacttgaattcaggcctcattggagccctactagtatgtagagaagggagtctggccaaggaaaagacacagaccttgcacaaatttatactactttttrctgtatttgatgaagggaaaagttggcactcagaaacaaagaactccttgatgcaggatagggatgctgcatctgctcgggcctggcctaaaatgcacac

SEQ ID NO: 3730 - DNA, 201 bp, Homo sapiens
aataatgaagaagcggaagactatgatgatgatcttactgattctgaaatggatgtggtcaggtttgatgatgacaactctccttcctttatccaaattcvctcagttgccaagaagcatcctaaaacttgggtacattacattgctgctgaagaggaggactgggactatgctcccttagtcctcgcccccgatgacaga

SEQ ID NO: 3731 - DNA, 201 bp, Homo sapiens
ttgaattcaggcctcattggagccctactagtatgtagagaagggagtctggccaaggaaaagacacagaccttgcacaaatttatactactttttgctgkatttgatgaagggaaaagttggcactcagaaacaaagaactccttgatgcaggatagggatgctgcatctgctcgggcctggcctaaaatgcacacagtc

SEQ ID NO: 3732 - DNA, 201 bp, Homo sapiens
tcaggcctcattggagccctactagtatgtagagaagggagtctggccaaggaaaagacacagaccttgcacaaatttatactactttttgctgtatttgwtgaagggaaaagttggcactcagaaacaaagaactccttgatgcaggatagggatgctgcatctgctcgggcctggcctaaaatgcacacagtcaatggt

SEQ ID NO: 3733 - DNA, 201 bp, Homo sapiens
gcctcattggagccctactagtatgtagagaagggagtctggccaaggaaaagacacagaccttgcacaaatttatactactttttgctgtatttgatgawgggaaaagttggcactcagaaacaaagaactccttgatgcaggatagggatgctgcatctgctcgggcctggcctaaaatgcacacagtcaatggttatg

SEQ ID NO: 3734 - DNA, 201 bp, Homo sapiens
actggaaccttaatggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagttgcagcatgccattgggaatggagagtaaagcaatatca

SEQ ID NO: 3735 - DNA, 201 bp, Homo sapiens
tgagtctggtggacctctgagcttgagtgaagaaaataatgattcaaagttgttagaatcaggtttaatgaatagccaagaaagttcatggggaaaaaatrtatcgtcaacagagagtggtaggttatttaaagggaaaagagctcatggacctgctttgttgactaaagataatgccttattcaaagttagcatctcttt

SEQ ID NO: 3736 - DNA, 201 bp, Homo sapiens
aggcctcattggagccctactagtatgtagagaagggagtctggccaaggaaaagacacagaccttgcacaaatttatactactttttgctgtatttgatraagggaaaagttggcactcagaaacaaagaactccttgatgcaggatagggatgctgcatctgctcgggcctggcctaaaatgcacacagtcaatggtta

SEQ ID NO: 3737 - DNA, 201 bp, Homo sapiens
atatctttctcatgtggacctggtaaaagacttgaattcaggcctcattggagccctactagtatgtagagaagggagtctggccaaggaaaagacacagmccttgcacaaatttatactactttttgctgtatttgatgaagggaaaagttggcactcagaaacaaagaactccttgatgcaggatagggatgctgcatc

SEQ ID NO: 3738 - DNA, 201 bp, Homo sapiens
tttgggactcctggggccatatataagagcagaagttgaagataatatcatggtaactttcagaaatcaggcctctcgtccctattccttctattctagcyttatttcttatgaggaagatcagaggcaaggagcagaacctagaaaaaactttgtcaagcctaatgaaaccaaaacttacttttggaaagtgcaacatca

SEQ ID NO: 3739 - DNA, 201 bp, Homo sapiens
aaagtccgatttatggcatacacagatgaaacctttaagactcgtgaagctattcagcatgaatcaggaatcttgggacctttactttatggggaagttgkagacacactgttgattatatttaagaatcaagcaagcagaccatataacatctaccctcacggaatcactgatgtccgtcctttgtattcaaggagatta

SEQ ID NO: 3740 - DNA, 201 bp, Homo sapiens
aatcactgatgtccgtcctttgtattcaaggagattaccaaaaggtgtaaaacatttgaaggattttccaattctgccaggagaaatattcaaatataaakggacagtgactgtagaagatgggccaactaaatcagatcctcggtgcctgacccgctattactctagtttcgttaatatggagagagatctagcttcagg

SEQ ID NO: 3741 - DNA, 201 bp, Homo sapiens
agagtggcagtgtccctcagttcaagaaagttgttttccaggaatttactgatggctcctttactcagcccttataccgtggagaactaaatgaacatttsggactcctggggccatatataagagcagaagttgaagataatatcatggtaactttcagaaatcaggcctctcgtccctattccttctattctagcctta

SEQ ID NO: 3742 - DNA, 201 bp, Homo sapiens
ctaaaatacaaaatgtctcctctagtgatttgttgatgctcttgcgacagagtcctactccacatgggctatccttatctgatctccaagaagccaaatakgagactttttctgatgatccatcacctggagcaatagacagtaataacagcctgtctgaaatgacacacttcaggccacagctccatcacagtggggaca

SEQ ID NO: 3743 - DNA, 201 bp, Homo sapiens
taataacagcctgtctgaaatgacacacttcaggccacagctccatcacagtggggacatggtatttacccctgagtcaggcctccaattaagattaaatkagaaactggggacaactgcagcaacagagttgaagaaacttgatttcaaagtttctagtacatcaaataatctgatttcaacaattccatcagacaattt

SEQ ID NO: 3744 - DNA, 201 bp, Homo sapiens
gaagaaacttgatttcaaagtttctagtacatcaaataatctgatttcaacaattccatcagacaatttggcagcaggtactgataatacaagttccttakgacccccaagtatgccagttcattatgatagtcaattagataccactctatttggcaaaaagtcatctccccttactgagtctggtggacctctgagctt

SEQ ID NO: 3745 - DNA, 201 bp, Homo sapiens
ttatgatagtcaattagataccactctatttggcaaaaagtcatctccccttactgagtctggtggacctctgagcttgagtgaagaaaataatgattcawagttgttagaatcaggtttaatgaatagccaagaaagttcatggggaaaaaatgtatcgtcaacagagagtggtaggttatttaaagggaaaagagctca

SEQ ID NO: 3746 - DNA, 201 bp, Homo sapiens
ggtagtaggaaagggtgaatttacaaaggacgtaggactcaaagagatggtttttccaagcagcagaaacctatttcttactaacttggataatttacatkaaaataatacacacaatcaagaaaaaaaaattcaggaagaaatagaaaagaaggaaacattaatccaagagaatgtagttttgcctcagatacatacagt

SEQ ID NO: 3747 - DNA, 201 bp, Homo sapiens
aaccaagcaaattgtagagaaatatgcatgcaccacaaggatatctcctaatacaagccagcagaattttgtcacgcaacgtagtaagagagctttgaaamaattcagactcccactagaagaaacagaacttgaaaaaaggataattgtggatgacacctcaacccagtggtccaaaaacatgaaacatttgaccccgag

SEQ ID NO: 3748 - DNA, 201 bp, Homo sapiens
ttttgtcacgcaacgtagtaagagagctttgaaacaattcagactcccactagaagaaacagaacttgaaaaaaggataattgtggatgacacctcaaccyagtggtccaaaaacatgaaacatttgaccccgagcaccctcacacagatagactacaatgagaaggagaaaggggccattactcagtctcccttatcaga

SEQ ID NO: 3749 - DNA, 201 bp, Homo sapiens
aaagaaagattctggggtccaagaaagcagtcatttcttacaaggagccaaaaaaaataacctttctttagccattctaaccttggagatgactggtgatyaaagagaggttggctccctggggacaagtgccacaaattcagtcacatacaagaaagttgagaacactgttctcccgaaaccagacttgcccaaaacatc

SEQ ID NO: 3750 - DNA, 201 bp, Homo sapiens
ttctttggcaatgtggattcatctgggataaaacacaatatttttaaccctccaattattgctcgatacatccgtttgcacccaactcattatagcattckcagcactcttcgcatggagttgatgggctgtgatttaaatagttgcagcatgccattgggaatggagagtaaagcaatatcagatgcacagattactgct

SEQ ID NO: 3751 - DNA, 201 bp, Homo sapiens
taatgaagaagcggaagactatgatgatgatcttactgattctgaaatggatgtggtcaggtttgatgatgacaactctccttcctttatccaaattcgcycagttgccaagaagcatcctaaaacttgggtacattacattgctgctgaagaggaggactgggactatgctcccttagtcctcgcccccgatgacagaag

SEQ ID NO: 3752 - DNA, 201 bp, Homo sapiens
aatgaagaagcggaagactatgatgatgatcttactgattctgaaatggatgtggtcaggtttgatgatgacaactctccttcctttatccaaattcgcthagttgccaagaagcatcctaaaacttgggtacattacattgctgctgaagaggaggactgggactatgctcccttagtcctcgcccccgatgacagaagt

SEQ ID NO: 3753 - DNA, 201 bp, Homo sapiens
ttctgaaatggatgtggtcaggtttgatgatgacaactctccttcctttatccaaattcgctcagttgccaagaagcatcctaaaacttgggtacattacwttgctgctgaagaggaggactgggactatgctcccttagtcctcgcccccgatgacagaagttataaaagtcaatatttgaacaatggccctcagcggat

SEQ ID NO: 3754 - DNA, 201 bp, Homo sapiens
ctactagtatgtagagaagggagtctggccaaggaaaagacacagaccttgcacaaatttatactactttttgctgtatttgatgaagggaaaagttggcrctcagaaacaaagaactccttgatgcaggatagggatgctgcatctgctcgggcctggcctaaaatgcacacagtcaatggttatgtaaacaggtctctg

SEQ ID NO: 3755 - DNA, 201 bp, Homo sapiens
gccaagaagcatcctaaaacttgggtacattacattgctgctgaagaggaggactgggactatgctcccttagtcctcgcccccgatgacagaagttatawaagtcaatatttgaacaatggccctcagcggattggtaggaagtacaaaaaagtccgatttatggcatacacagatgaaacctttaagactcgtgaagct

SEQ ID NO: 3756 - DNA, 201 bp, Homo sapiens
aggaaccatcgccaggcgtccttggaaatctcgccaataactttccttactgctcaaacactcttgatggaccttggacagtttctactgttttgtcatakctcttcccaccaacatgatggcatggaagcttatgtcaaagtagacagctgtccagaggaaccccaactacgaatgaaaaataatgaagaagcggaagac

SEQ ID NO: 3757 - DNA, 201 bp, Homo sapiens
gaaatctcgccaataactttccttactgctcaaacactcttgatggaccttggacagtttctactgttttgtcatatctcttcccaccaacatgatggcayggaagcttatgtcaaagtagacagctgtccagaggaaccccaactacgaatgaaaaataatgaagaagcggaagactatgatgatgatcttactgattct

SEQ ID NO: 3758 - DNA, 201 bp, Homo sapiens
actgatggctcctttactcagcccttataccgtggagaactaaatgaacatttgggactcctggggccatatataagagcagaagttgaagataatatcayggtaactttcagaaatcaggcctctcgtccctattccttctattctagccttatttcttatgaggaagatcagaggcaaggagcagaacctagaaaaaac

SEQ ID NO: 3759 - DNA, 201 bp, Homo sapiens
gactgggactatgctcccttagtcctcgcccccgatgacagaagttataaaagtcaatatttgaacaatggccctcagcggattggtaggaagtacaaaaragtccgatttatggcatacacagatgaaacctttaagactcgtgaagctattcagcatgaatcaggaatcttgggacctttactttatggggaagttgga

SEQ ID NO: 3760 - DNA, 201 bp, Homo sapiens
caataactttccttactgctcaaacactcttgatggaccttggacagtttctactgttttgtcatatctcttcccaccaacatgatggcatggaagcttawgtcaaagtagacagctgtccagaggaaccccaactacgaatgaaaaataatgaagaagcggaagactatgatgatgatcttactgattctgaaatggatg

SEQ ID NO: 3761 - DNA, 201 bp, Homo sapiens
ggactatgctcccttagtcctcgcccccgatgacagaagttataaaagtcaatatttgaacaatggccctcagcggattggtaggaagtacaaaaaagtcygatttatggcatacacagatgaaacctttaagactcgtgaagctattcagcatgaatcaggaatcttgggacctttactttatggggaagttggagacac

SEQ ID NO: 3762 - DNA, 201 bp, Homo sapiens
cctaaaacttgggtacattacattgctgctgaagaggaggactgggactatgctcccttagtcctcgcccccgatgacagaagttataaaagtcaatattygaacaatggccctcagcggattggtaggaagtacaaaaaagtccgatttatggcatacacagatgaaacctttaagactcgtgaagctattcagcatgaa

SEQ ID NO: 3763 - DNA, 201 bp, Homo sapiens
cttagtcctcgcccccgatgacagaagttataaaagtcaatatttgaacaatggccctcagcggattggtaggaagtacaaaaaagtccgatttatggcawacacagatgaaacctttaagactcgtgaagctattcagcatgaatcaggaatcttgggacctttactttatggggaagttggagacacactgttgattat

SEQ ID NO: 3764 - DNA, 201 bp, Homo sapiens
tcagagtggcagtgtccctcagttcaagaaagttgttttccaggaatttactgatggctcctttactcagcccttataccgtggagaactaaatgaacatktgggactcctggggccatatataagagcagaagttgaagataatatcatggtaactttcagaaatcaggcctctcgtccctattccttctattctagcct

SEQ ID NO: 3765 - DNA, 201 bp, Homo sapiens
agaaacagggctcagagtggcagtgtccctcagttcaagaaagttgttttccaggaatttactgatggctcctttactcagcccttataccgtggagaacyaaatgaacatttgggactcctggggccatatataagagcagaagttgaagataatatcatggtaactttcagaaatcaggcctctcgtccctattccttc

SEQ ID NO: 3766 - DNA, 201 bp, Homo sapiens
acagatgaaacctttaagactcgtgaagctattcagcatgaatcaggaatcttgggacctttactttatggggaagttggagacacactgttgattatatktaagaatcaagcaagcagaccatataacatctaccctcacggaatcactgatgtccgtcctttgtattcaaggagattaccaaaaggtgtaaaacatttg

SEQ ID NO: 3767 - DNA, 201 bp, Homo sapiens
catgttctaagaaacagggctcagagtggcagtgtccctcagttcaagaaagttgttttccaggaatttactgatggctcctttactcagcccttataccrtggagaactaaatgaacatttgggactcctggggccatatataagagcagaagttgaagataatatcatggtaactttcagaaatcaggcctctcgtccc

SEQ ID NO: 3768 - DNA, 201 bp, Homo sapiens
gatgaaacctttaagactcgtgaagctattcagcatgaatcaggaatcttgggacctttactttatggggaagttggagacacactgttgattatatttamgaatcaagcaagcagaccatataacatctaccctcacggaatcactgatgtccgtcctttgtattcaaggagattaccaaaaggtgtaaaacatttgaag

SEQ ID NO: 3769 - DNA, 201 bp, Homo sapiens
aaggaagattttgacatttatgatgaggatgaaaatcagagcccccgcagctttcaaaagaaaacacgacactattttattgctgcagtggagaggctctrggattatgggatgagtagctccccacatgttctaagaaacagggctcagagtggcagtgtccctcagttcaagaaagttgttttccaggaatttactgat

SEQ ID NO: 3770 - DNA, 201 bp, Homo sapiens
cagatcaagaggaaattgactatgatgataccatatcagttgaaatgaagaaggaagattttgacatttatgatgaggatgaaaatcagagcccccgcagmtttcaaaagaaaacacgacactattttattgctgcagtggagaggctctgggattatgggatgagtagctccccacatgttctaagaaacagggctcaga

SEQ ID NO: 3771 - DNA, 201 bp, Homo sapiens
tgctgctgaagaggaggactgggactatgctcccttagtcctcgcccccgatgacagaagttataaaagtcaatatttgaacaatggccctcagcggattrgtaggaagtacaaaaaagtccgatttatggcatacacagatgaaacctttaagactcgtgaagctattcagcatgaatcaggaatcttgggacctttact

SEQ ID NO: 3772 - DNA, 201 bp, Homo sapiens
atcccaagagaagtcaccagaaaaaacagcttttaagaaaaaggataccattttgtccctgaacgcttgtgaaagcaatcatgcaatagcagcaataaatkagggacaaaataagcccgaaatagaagtcacctgggcaaagcaaggtaggactgaaaggctgtgctctcaaaacccaccagtcttgaaacgccatcaacg

SEQ ID NO: 3773 - DNA, 201 bp, Homo sapiens
ttctgagagtagcaacagaaagctctgcaaagactccctccaagctattggatcctcttgcttgggataaccactatggtactcagataccaaaagaagaktggaaatcccaagagaagtcaccagaaaaaacagcttttaagaaaaaggataccattttgtccctgaacgcttgtgaaagcaatcatgcaatagcagcaa

SEQ ID NO: 3774 - DNA, 201 bp, Homo sapiens
aattgactatgatgataccatatcagttgaaatgaagaaggaagattttgacatttatgatgaggatgaaaatcagagcccccgcagctttcaaaagaaawcacgacactattttattgctgcagtggagaggctctgggattatgggatgagtagctccccacatgttctaagaaacagggctcagagtggcagtgtccc

SEQ ID NO: 3775 - DNA, 201 bp, Homo sapiens
agtggaatgaagcaaacagacctggaaaagttccctttctgagagtagcaacagaaagctctgcaaagactccctccaagctattggatcctcttgcttgrgataaccactatggtactcagataccaaaagaagagtggaaatcccaagagaagtcaccagaaaaaacagcttttaagaaaaaggataccattttgtccc

SEQ ID NO: 3776 - DNA, 201 bp, Homo sapiens
ggcagtgtccctcagttcaagaaagttgttttccaggaatttactgatggctcctttactcagcccttataccgtggagaactaaatgaacatttgggacycctggggccatatataagagcagaagttgaagataatatcatggtaactttcagaaatcaggcctctcgtccctattccttctattctagccttatttct

SEQ ID NO: 3777 - DNA, 201 bp, Homo sapiens
aagtggaatgaagcaaacagacctggaaaagttccctttctgagagtagcaacagaaagctctgcaaagactccctccaagctattggatcctcttgcttrggataaccactatggtactcagataccaaaagaagagtggaaatcccaagagaagtcaccagaaaaaacagcttttaagaaaaaggataccattttgtcc

SEQ ID NO: 3778 - DNA, 201 bp, Homo sapiens
acccactaaagatgagtttgactgcaaagcctgggcttatttctctgatgttgacctggaaaaagatgtgcactcaggcctgattggaccccttctggtcygccacactaacacactgaaccctgctcatgggagacaagtgacagtacaggaatttgctctgtttttcaccatctttgatgagaccaaaagctggtactt

SEQ ID NO: 3779 - DNA, 201 bp, Homo sapiens
tgaaaatatggaaagaaactgcagggctccctgcaatatccagatggaagatcccacttttaaagagaattatcgcttccatgcaatcaatggctacatartggatacactacctggcttagtaatggctcaggatcaaaggattcgatggtatctgctcagcatgggcagcaatgaaaacatccattctattcatttcag

SEQ ID NO: 3780 - DNA, 201 bp, Homo sapiens
aaagagaattatcgcttccatgcaatcaatggctacataatggatacactacctggcttagtaatggctcaggatcaaaggattcgatggtatctgctcakcatgggcagcaatgaaaacatccattctattcatttcagtggacatgtgttcactgtacgaaaaaaagaggagtataaaatggcactgtacaatctctat

SEQ ID NO: 3781 - DNA, 201 bp, Homo sapiens
aacatccattctattcatttcagtggacatgtgttcactgtacgaaaaaaagaggagtataaaatggcactgtacaatctctatccaggtgtttttgagasagtggaaatgttaccatccaaagctggaatttggcgggtggaatgccttattggcgagcatctacatgctgggatgagcacactttttctggtgtacagc

SEQ ID NO: 3782 - DNA, 201 bp, Homo sapiens
caagggaggagtaatgcctggagacctcaggtgaataatccaaaagagtggctgcaagtggacttccagaagacaatgaaagtcacaggagtaactactcrgggagtaaaatctctgcttaccagcatgtatgtgaaggagttcctcatctccagcagtcaagatggccatcagtggactctcttttttcagaatggcaaa

SEQ ID NO: 3783 - DNA, 201 bp, Homo sapiens
tttaagactcgtgaagctattcagcatgaatcaggaatcttgggacctttactttatggggaagttggagacacactgttgattatatttaagaatcaagbaagcagaccatataacatctaccctcacggaatcactgatgtccgtcctttgtattcaaggagattaccaaaaggtgtaaaacatttgaaggattttcca

SEQ ID NO: 3784 - DNA, 201 bp, Homo sapiens
aatagttgcagcatgccattgggaatggagagtaaagcaatatcagatgcacagattactgcttcatcctactttaccaatatgtttgccacctggtctcyttcaaaagctcgacttcacctccaagggaggagtaatgcctggagacctcaggtgaataatccaaaagagtggctgcaagtggacttccagaagacaatg

SEQ ID NO: 3785 - DNA, 201 bp, Homo sapiens
actgttgattatatttaagaatcaagcaagcagaccatataacatctaccctcacggaatcactgatgtccgtcctttgtattcaaggagattaccaaaargtgtaaaacatttgaaggattttccaattctgccaggagaaatattcaaatataaatggacagtgactgtagaagatgggccaactaaatcagatcctcg

SEQ ID NO: 3786 - DNA, 201 bp, Homo sapiens
ctctcttttttcagaatggcaaagtaaaggtttttcagggaaatcaagactccttcacacctgtggtgaactctctagacccaccgttactgactcgctascttcgaattcacccccagagttgggtgcaccagattgccctgaggatggaggttctgggctgcgaggcacaggacctctactgagggtggccactgcagc

SEQ ID NO: 3787 - DNA, 201 bp, Homo sapiens
gatcctcggtgcctgacccgctattactctagtttcgttaatatggagagagatctagcttcaggactcattggccctctcctcatctgctacaaagaatytgtagatcaaagaggaaaccagataatgtcagacaagaggaatgtcatcctgttttctgtatttgatgagaaccgaagctggtacctcacagagaatata

SEQ ID NO: 3788 - DNA, 201 bp, Homo sapiens
gtggtgaactctctagacccaccgttactgactcgctaccttcgaattcacccccagagttgggtgcaccagattgccctgaggatggaggttctgggctrcgaggcacaggacctctactgagggtggccactgcagcacctgccactgccgtcacctctccctcctcagctccagggcagtgtccctccctggcttgcc

SEQ ID NO: 3789 - DNA, 201 bp, Homo sapiens
cctcggtgcctgacccgctattactctagtttcgttaatatggagagagatctagcttcaggactcattggccctctcctcatctgctacaaagaatctgyagatcaaagaggaaaccagataatgtcagacaagaggaatgtcatcctgttttctgtatttgatgagaaccgaagctggtacctcacagagaatatacaa

SEQ ID NO: 3790 - DNA, 201 bp, Homo sapiens
ttgtttgcatgaggtggcatactggtacattctaagcattggagcacagactgacttcctttctgtcttcttctctggatataccttcaaacacaaaatgktctatgaagacacactcaccctattcccattctcaggagaaactgtcttcatgtcgatggaaaacccaggtctatggattctggggtgccacaactcaga

SEQ ID NO: 3791 - DNA, 201 bp, Homo sapiens
cggtgcctgacccgctattactctagtttcgttaatatggagagagatctagcttcaggactcattggccctctcctcatctgctacaaagaatctgtagmtcaaagaggaaaccagataatgtcagacaagaggaatgtcatcctgttttctgtatttgatgagaaccgaagctggtacctcacagagaatatacaacgc

SEQ ID NO: 3792 - DNA, 201 bp, Homo sapiens
tcggtgcctgacccgctattactctagtttcgttaatatggagagagatctagcttcaggactcattggccctctcctcatctgctacaaagaatctgtasatcaaagaggaaaccagataatgtcagacaagaggaatgtcatcctgttttctgtatttgatgagaaccgaagctggtacctcacagagaatatacaacg

SEQ ID NO: 3793 - DNA, 201 bp, Homo sapiens
cgctattactctagtttcgttaatatggagagagatctagcttcaggactcattggccctctcctcatctgctacaaagaatctgtagatcaaagaggaarccagataatgtcagacaagaggaatgtcatcctgttttctgtatttgatgagaaccgaagctggtacctcacagagaatatacaacgctttctccccaat

SEQ ID NO: 3794 - DNA, 201 bp, Homo sapiens
attactctagtttcgttaatatggagagagatctagcttcaggactcattggccctctcctcatctgctacaaagaatctgtagatcaaagaggaaaccakataatgtcagacaagaggaatgtcatcctgttttctgtatttgatgagaaccgaagctggtacctcacagagaatatacaacgctttctccccaatccag

SEQ ID NO: 3795 - DNA, 201 bp, Homo sapiens
cccgatgacagaagttataaaagtcaatatttgaacaatggccctcagcggattggtaggaagtacaaaaaagtccgatttatggcatacacagatgaaayctttaagactcgtgaagctattcagcatgaatcaggaatcttgggacctttactttatggggaagttggagacacactgttgattatatttaagaatcaa

SEQ ID NO: 3796 - DNA, 201 bp, Homo sapiens
ctattactctagtttcgttaatatggagagagatctagcttcaggactcattggccctctcctcatctgctacaaagaatctgtagatcaaagaggaaacmagataatgtcagacaagaggaatgtcatcctgttttctgtatttgatgagaaccgaagctggtacctcacagagaatatacaacgctttctccccaatcc

SEQ ID NO: 3797 - DNA, 201 bp, Homo sapiens
tggaaccttaatggtcttctttggcaatgtggattcatctgggataaaacacaatatttttaaccctccaattattgctcgatacatccgtttgcacccarctcattatagcattcgcagcactcttcgcatggagttgatgggctgtgatttaaatagttgcagcatgccattgggaatggagagtaaagcaatatcaga

SEQ ID NO: 3798 - DNA, 201 bp, Homo sapiens
tataagagcagaagttgaagataatatcatggtaactttcagaaatcaggcctctcgtccctattccttctattctagccttatttcttatgaggaagatyagaggcaaggagcagaacctagaaaaaactttgtcaagcctaatgaaaccaaaacttacttttggaaagtgcaacatcatatggcacccactaaagatga

SEQ ID NO: 3799 - DNA, 201 bp, Homo sapiens
tttcttatgaggaagatcagaggcaaggagcagaacctagaaaaaactttgtcaagcctaatgaaaccaaaacttacttttggaaagtgcaacatcatatrgcacccactaaagatgagtttgactgcaaagcctgggcttatttctctgatgttgacctggaaaaagatgtgcactcaggcctgattggaccccttctgg

SEQ ID NO: 3800 - DNA, 201 bp, Homo sapiens
ttatgaggaagatcagaggcaaggagcagaacctagaaaaaactttgtcaagcctaatgaaaccaaaacttacttttggaaagtgcaacatcatatggcayccactaaagatgagtttgactgcaaagcctgggcttatttctctgatgttgacctggaaaaagatgtgcactcaggcctgattggaccccttctggtctg

SEQ ID NO: 3801 - DNA, 201 bp, Homo sapiens
tgaggaagatcagaggcaaggagcagaacctagaaaaaactttgtcaagcctaatgaaaccaaaacttacttttggaaagtgcaacatcatatggcacccmctaaagatgagtttgactgcaaagcctgggcttatttctctgatgttgacctggaaaaagatgtgcactcaggcctgattggaccccttctggtctgcca

SEQ ID NO: 3802 - DNA, 201 bp, Homo sapiens
ggaagatcagaggcaaggagcagaacctagaaaaaactttgtcaagcctaatgaaaccaaaacttacttttggaaagtgcaacatcatatggcacccactwaagatgagtttgactgcaaagcctgggcttatttctctgatgttgacctggaaaaagatgtgcactcaggcctgattggaccccttctggtctgccacac

SEQ ID NO: 3803 - DNA, 201 bp, Homo sapiens
tattccaagacaactcttctcatcttccagcagcatcttatagaaagaaagattctggggtccaagaaagcagtcatttcttacaaggagccaaaaaaaawaacctttctttagccattctaaccttggagatgactggtgatcaaagagaggttggctccctggggacaagtgccacaaattcagtcacatacaagaaag

SEQ ID NO: 3804 - DNA, 201 bp, Homo sapiens
tgattcaacaaatagaacaaagaaacacacagctcatttctcaaaaaaaggggaggaagaaaacttggaaggcttgggaaatcaaaccaagcaaattgtakagaaatatgcatgcaccacaaggatatctcctaatacaagccagcagaattttgtcacgcaacgtagtaagagagctttgaaacaattcagactcccact

SEQ ID NO: 3805 - DNA, 201 bp, Homo sapiens
tggtacattctaagcattggagcacagactgacttcctttctgtcttcttctctggatataccttcaaacacaaaatggtctatgaagacacactcaccckattcccattctcaggagaaactgtcttcatgtcgatggaaaacccaggtctatggattctggggtgccacaactcagactttcggaacagaggcatgacc

SEQ ID NO: 3806 - DNA, 201 bp, Homo sapiens
atgaagaaccttttcttactgagcactaggcaaaatgtagaaggttcatatgagggggcatatgctccagtacttcaagattttaggtcattaaatgattsaacaaatagaacaaagaaacacacagctcatttctcaaaaaaaggggaggaagaaaacttggaaggcttgggaaatcaaaccaagcaaattgtagagaaa

SEQ ID NO: 3807 - DNA, 201 bp, Homo sapiens
gtggcatactggtacattctaagcattggagcacagactgacttcctttctgtcttcttctctggatataccttcaaacacaaaatggtctatgaagacasactcaccctattcccattctcaggagaaactgtcttcatgtcgatggaaaacccaggtctatggattctggggtgccacaactcagactttcggaacaga

SEQ ID NO: 3808 - DNA, 201 bp, Homo sapiens
tcatggaaagaactctctgaactctgggcaaggccccagtccaaagcaattagtatccttaggaccagaaaaatctgtggaaggtcagaatttcttgtctkagaaaaacaaagtggtagtaggaaagggtgaatttacaaaggacgtaggactcaaagagatggtttttccaagcagcagaaacctatttcttactaactt

SEQ ID NO: 3809 - DNA, 201 bp, Homo sapiens
ttgcatgaggtggcatactggtacattctaagcattggagcacagactgacttcctttctgtcttcttctctggatataccttcaaacacaaaatggtctrtgaagacacactcaccctattcccattctcaggagaaactgtcttcatgtcgatggaaaacccaggtctatggattctggggtgccacaactcagacttt

SEQ ID NO: 3810 - DNA, 201 bp, Homo sapiens
caataattcagcaactaatagaaagactcacattgatggcccatcattattaattgagaatagtccatcagtctggcaaaatatattagaaagtgacactragtttaaaaaagtgacacctttgattcatgacagaatgcttatggacaaaaatgctacagctttgaggctaaatcatatgtcaaataaaactacttcatc

SEQ ID NO: 3811 - DNA, 201 bp, Homo sapiens
tttgcatgaggtggcatactggtacattctaagcattggagcacagactgacttcctttctgtcttcttctctggatataccttcaaacacaaaatggtcwatgaagacacactcaccctattcccattctcaggagaaactgtcttcatgtcgatggaaaacccaggtctatggattctggggtgccacaactcagactt

SEQ ID NO: 3812 - DNA, 201 bp, Homo sapiens
atggggaaaaaatgtatcgtcaacagagagtggtaggttatttaaagggaaaagagctcatggacctgctttgttgactaaagataatgccttattcaaasttagcatctctttgttaaagacaaacaaaacttccaataattcagcaactaatagaaagactcacattgatggcccatcattattaattgagaatagtcc

SEQ ID NO: 3813 - DNA, 201 bp, Homo sapiens
gcagcaggtactgataatacaagttccttaggacccccaagtatgccagttcattatgatagtcaattagataccactctatttggcaaaaagtcatctcsccttactgagtctggtggacctctgagcttgagtgaagaaaataatgattcaaagttgttagaatcaggtttaatgaatagccaagaaagttcatgggga

SEQ ID NO: 3814 - DNA, 201 bp, Homo sapiens
tttgcagttgtcagtttgtttgcatgaggtggcatactggtacattctaagcattggagcacagactgacttcctttctgtcttcttctctggatataccytcaaacacaaaatggtctatgaagacacactcaccctattcccattctcaggagaaactgtcttcatgtcgatggaaaacccaggtctatggattctggg

SEQ ID NO: 3815 - DNA, 201 bp, Homo sapiens
ccatcacctggagcaatagacagtaataacagcctgtctgaaatgacacacttcaggccacagctccatcacagtggggacatggtatttacccctgagtsaggcctccaattaagattaaatgagaaactggggacaactgcagcaacagagttgaagaaacttgatttcaaagtttctagtacatcaaataatctgatt

SEQ ID NO: 3816 - DNA, 201 bp, Homo sapiens
tccagaaaatgacatagagaagactgacccttggtttgcacacagaacacctatgcctaaaatacaaaatgtctcctctagtgatttgttgatgctcttgygacagagtcctactccacatgggctatccttatctgatctccaagaagccaaatatgagactttttctgatgatccatcacctggagcaatagacagtaa

SEQ ID NO: 3817 - DNA, 201 bp, Homo sapiens
actttcggaacagaggcatgaccgccttactgaaggtttctagttgtgacaagaacactggtgattattacgaggacagttatgaagatatttcagcatamttgctgagtaaaaacaatgccattgaaccaagaagcttctcccagaattcaagacaccctagcactaggcaaaagcaatttaatgccaccacaattccag

SEQ ID NO: 3818 - DNA, 201 bp, Homo sapiens
gatttaaatagttgcagcatgccattgggaatggagagtaaagcaatatcagatgcacagattactgcttcatcctactttaccaatatgtttgccacctrgtctccttcaaaagctcgacttcacctccaagggaggagtaatgcctggagacctcaggtgaataatccaaaagagtggctgcaagtggacttccagaag

SEQ ID NO: 3819 - DNA, 201 bp, Homo sapiens
tactctagtttcgttaatatggagagagatctagcttcaggactcattggccctctcctcatctgctacaaagaatctgtagatcaaagaggaaaccagabaatgtcagacaagaggaatgtcatcctgttttctgtatttgatgagaaccgaagctggtacctcacagagaatatacaacgctttctccccaatccagct

SEQ ID NO: 3820 - DNA, 201 bp, Homo sapiens
ctctagtttcgttaatatggagagagatctagcttcaggactcattggccctctcctcatctgctacaaagaatctgtagatcaaagaggaaaccagatartgtcagacaagaggaatgtcatcctgttttctgtatttgatgagaaccgaagctggtacctcacagagaatatacaacgctttctccccaatccagctgg

SEQ ID NO: 3821 - DNA, 201 bp, Homo sapiens
gtagctccccacatgttctaagaaacagggctcagagtggcagtgtccctcagttcaagaaagttgttttccaggaatttactgatggctcctttactcarcccttataccgtggagaactaaatgaacatttgggactcctggggccatatataagagcagaagttgaagataatatcatggtaactttcagaaatcagg

SEQ ID NO: 3822 - DNA, 201 bp, Homo sapiens
agtttcgttaatatggagagagatctagcttcaggactcattggccctctcctcatctgctacaaagaatctgtagatcaaagaggaaaccagataatgtmagacaagaggaatgtcatcctgttttctgtatttgatgagaaccgaagctggtacctcacagagaatatacaacgctttctccccaatccagctggagtg

SEQ ID NO: 3823 - DNA, 201 bp, Homo sapiens
tcagcccttataccgtggagaactaaatgaacatttgggactcctggggccatatataagagcagaagttgaagataatatcatggtaactttcagaaatyaggcctctcgtccctattccttctattctagccttatttcttatgaggaagatcagaggcaaggagcagaacctagaaaaaactttgtcaagcctaatga

SEQ ID NO: 3824 - DNA, 201 bp, Homo sapiens
gcccttataccgtggagaactaaatgaacatttgggactcctggggccatatataagagcagaagttgaagataatatcatggtaactttcagaaatcagscctctcgtccctattccttctattctagccttatttcttatgaggaagatcagaggcaaggagcagaacctagaaaaaactttgtcaagcctaatgaaac

SEQ ID NO: 3825 - DNA, 201 bp, Homo sapiens
tttgtcaagcctaatgaaaccaaaacttacttttggaaagtgcaacatcatatggcacccactaaagatgagtttgactgcaaagcctgggcttatttctstgatgttgacctggaaaaagatgtgcactcaggcctgattggaccccttctggtctgccacactaacacactgaaccctgctcatgggagacaagtgaca

SEQ ID NO: 3826 - DNA, 201 bp, Homo sapiens
aaaactttgtcaagcctaatgaaaccaaaacttacttttggaaagtgcaacatcatatggcacccactaaagatgagtttgactgcaaagcctgggcttakttctctgatgttgacctggaaaaagatgtgcactcaggcctgattggaccccttctggtctgccacactaacacactgaaccctgctcatgggagacaag

SEQ ID NO: 3827 - DNA, 201 bp, Homo sapiens
aaccaaaacttacttttggaaagtgcaacatcatatggcacccactaaagatgagtttgactgcaaagcctgggcttatttctctgatgttgacctggaaraagatgtgcactcaggcctgattggaccccttctggtctgccacactaacacactgaaccctgctcatgggagacaagtgacagtacaggaatttgctct

SEQ ID NO: 3828 - DNA, 201 bp, Homo sapiens
tccaacatcatgcacagcatcaatggctatgtttttgatagtttgcagttgtcagtttgtttgcatgaggtggcatactggtacattctaagcattggagyacagactgacttcctttctgtcttcttctctggatataccttcaaacacaaaatggtctatgaagacacactcaccctattcccattctcaggagaaact

SEQ ID NO: 3829 - DNA, 201 bp, Homo sapiens
tgatctcggtgagctgcctgtggacgcaagatttcctcctagagtgccaaaatcttttccattcaacacctcagtcgtgtacaaaaagactctgtttgtaraattcacggatcaccttttcaacatcgctaagccaaggccaccctggatgggtctgctaggtcctaccatccaggctgaggtttatgatacagtggtcat

SEQ ID NO: 3830 - DNA, 201 bp, Homo sapiens
gagttccaagcctccaacatcatgcacagcatcaatggctatgtttttgatagtttgcagttgtcagtttgtttgcatgaggtggcatactggtacattcyaagcattggagcacagactgacttcctttctgtcttcttctctggatataccttcaaacacaaaatggtctatgaagacacactcaccctattcccattc

SEQ ID NO: 3831 - DNA, 201 bp, Homo sapiens
tttgactgcaaagcctgggcttatttctctgatgttgacctggaaaaagatgtgcactcaggcctgattggaccccttctggtctgccacactaacacacygaaccctgctcatgggagacaagtgacagtacaggaatttgctctgtttttcaccatctttgatgagaccaaaagctggtacttcactgaaaatatggaa

SEQ ID NO: 3832 - DNA, 201 bp, Homo sapiens
gcttatttctctgatgttgacctggaaaaagatgtgcactcaggcctgattggaccccttctggtctgccacactaacacactgaaccctgctcatgggakacaagtgacagtacaggaatttgctctgtttttcaccatctttgatgagaccaaaagctggtacttcactgaaaatatggaaagaaactgcagggctccc

SEQ ID NO: 3833 - DNA, 201 bp, Homo sapiens
ctggggtgccacaactcagactttcggaacagaggcatgaccgccttactgaaggtttctagttgtgacaagaacactggtgattattacgaggacagttrtgaagatatttcagcatacttgctgagtaaaaacaatgccattgaaccaagaagcttctcccagaattcaagacaccctagcactaggcaaaagcaattt

SEQ ID NO: 3834 - DNA, 201 bp, Homo sapiens
ttgaggatccagagttccaagcctccaacatcatgcacagcatcaatggctatgtttttgatagtttgcagttgtcagtttgtttgcatgaggtggcatastggtacattctaagcattggagcacagactgacttcctttctgtcttcttctctggatataccttcaaacacaaaatggtctatgaagacacactcaccc

SEQ ID NO: 3835 - DNA, 201 bp, Homo sapiens
gtgcagcttgaggatccagagttccaagcctccaacatcatgcacagcatcaatggctatgtttttgatagtttgcagttgtcagtttgtttgcatgaggyggcatactggtacattctaagcattggagcacagactgacttcctttctgtcttcttctctggatataccttcaaacacaaaatggtctatgaagacaca

SEQ ID NO: 3836 - DNA, 201 bp, Homo sapiens
tctatggattctggggtgccacaactcagactttcggaacagaggcatgaccgccttactgaaggtttctagttgtgacaagaacactggtgattattacraggacagttatgaagatatttcagcatacttgctgagtaaaaacaatgccattgaaccaagaagcttctcccagaattcaagacaccctagcactaggca

SEQ ID NO: 3837 - DNA, 201 bp, Homo sapiens
agtgcagcttgaggatccagagttccaagcctccaacatcatgcacagcatcaatggctatgtttttgatagtttgcagttgtcagtttgtttgcatgagrtggcatactggtacattctaagcattggagcacagactgacttcctttctgtcttcttctctggatataccttcaaacacaaaatggtctatgaagacac

SEQ ID NO: 3838 - DNA, 201 bp, Homo sapiens
gtctatggattctggggtgccacaactcagactttcggaacagaggcatgaccgccttactgaaggtttctagttgtgacaagaacactggtgattattasgaggacagttatgaagatatttcagcatacttgctgagtaaaaacaatgccattgaaccaagaagcttctcccagaattcaagacaccctagcactaggc

SEQ ID NO: 3839 - DNA, 201 bp, Homo sapiens
aggagaaactgtcttcatgtcgatggaaaacccaggtctatggattctggggtgccacaactcagactttcggaacagaggcatgaccgccttactgaagktttctagttgtgacaagaacactggtgattattacgaggacagttatgaagatatttcagcatacttgctgagtaaaaacaatgccattgaaccaagaag

SEQ ID NO: 3840 - DNA, 201 bp, Homo sapiens
attcccattctcaggagaaactgtcttcatgtcgatggaaaacccaggtctatggattctggggtgccacaactcagactttcggaacagaggcatgaccrccttactgaaggtttctagttgtgacaagaacactggtgattattacgaggacagttatgaagatatttcagcatacttgctgagtaaaaacaatgccat

SEQ ID NO: 3841 - DNA, 201 bp, Homo sapiens; identical to SEQ ID NO: 3643

SEQ ID NO: 3842 - DNA, 201 bp, Homo sapiens; identical to SEQ ID NO: 3531

SEQ ID NO: 3843 - DNA, 201 bp, Homo sapiens; identical to SEQ ID NO: 3645

SEQ ID NO: 3844 - DNA, 201 bp, Homo sapiens; identical to SEQ ID NO: 3644

SEQ ID NO: 3845 - DNA, 201 bp, Homo sapiens; identical to SEQ ID NO: 3532

SEQ ID NO: 3846 - DNA, 201 bp, Homo sapiens; identical to SEQ ID NO: 3782

SEQ ID NO: 3847 - DNA, 201 bp, Homo sapiens; identical to SEQ ID NO: 3613

SEQ ID NO: 3848 - DNA, 201 bp, Homo sapiens; identical to SEQ ID NO: 3483

SEQ ID NO: 3849 - DNA, 201 bp, Homo sapiens; identical to SEQ ID NO: 3571

SEQ ID NO: 3850 - DNA, 201 bp, Homo sapiens; identical to SEQ ID NO: 3784

SEQ ID NO: 3851 - DNA, 201 bp, Homo sapiens; identical to SEQ ID NO: 3786

SEQ ID NO: 3852 - DNA, 201 bp, Homo sapiens; identical to SEQ ID NO: 3788

SEQ ID NO: 3853 - DNA, 201 bp, Homo sapiens; identical to SEQ ID NO: 3575

SEQ ID NO: 3854 - DNA, 201 bp, Homo sapiens; identical to SEQ ID NO: 3576

SEQ ID NO: 3855 - DNA, 201 bp, Homo sapiens
gatgcggatccaagaccctgggaaggtcttctttggcaatgtggattcatctgggataaaacacaatatttttaaccctccaattattgctcgatacatcygtttgcacccaactcattatagcattcgcagcactcttcgcatggagttgatgggctgtgatttaaatagttgcagcatgccattgggaatggagagtaa

SEQ ID NO: 3856 - DNA, 201 bp, Homo sapiens
agaccctgggaaggtcttctttggcaatgtggattcatctgggataaaacacaatatttttaaccctccaattattgctcgatacatccgtttgcacccarctcattatagcattcgcagcactcttcgcatggagttgatgggctgtgatttaaatagttgcagcatgccattgggaatggagagtaaagcaatatcaga

SEQ ID NO: 3857 - DNA, 201 bp, Homo sapiens; identical to SEQ ID NO: 3722

SEQ ID NO: 3858 - DNA, 201 bp, Homo sapiens; identical to SEQ ID NO: 3686

SEQ ID NO: 3859 - DNA, 201 bp, Homo sapiens
atgcggatccaagaccctgggaaggtcttctttggcaatgtggattcatctgggataaaacacaatatttttaaccctccaattattgctcgatacatccrtttgcacccaactcattatagcattcgcagcactcttcgcatggagttgatgggctgtgatttaaatagttgcagcatgccattgggaatggagagtaaa

SEQ ID NO: 3860 - DNA, 201 bp, Homo sapiens; identical to SEQ ID NO: 3724

SEQ ID NO: 3861 - DNA, 201 bp, Homo sapiens; identical to SEQ ID NO: 3688

SEQ ID NO: 3862 - DNA, 201 bp, Homo sapiens; identical to SEQ ID NO: 3584

SEQ ID NO: 3863 - DNA, 201 bp, Homo sapiens
caagaccctgggaaggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagttgcagcatgccattgggaatggagagtaaagcaatatca

SEQ ID NO: 3864 - DNA, 201 bp, Homo sapiens; identical to SEQ ID NO: 3652

SEQ ID NO: 3865 - DNA, 201 bp, Homo sapiens; identical to SEQ ID NO: 3625

SEQ ID NO: 3866 - DNA, 201 bp, Homo sapiens; identical to SEQ ID NO: 3626

SEQ ID NO: 3867 - DNA, 201 bp, Homo sapiens; identical to SEQ ID NO: 3547

SEQ ID NO: 3868 - DNA, 201 bp, Homo sapiens; identical to SEQ ID NO: 3627

SEQ ID NO: 3869 - DNA, 201 bp, Homo sapiens; identical to SEQ ID NO: 3503

SEQ ID NO: 3870 - DNA, 201 bp, Homo sapiens; identical to SEQ ID NO: 3656

SEQ ID NO: 3871 - DNA, 201 bp, Homo sapiens; identical to SEQ ID NO: 3657

SEQ ID NO: 3872 - DNA, 201 bp, Homo sapiens; identical to SEQ ID NO: 3549

SEQ ID NO: 3873 - DNA, 201 bp, Homo sapiens
ggctgtgagcggcgtatgcaaatcgagggtctcggggatgcggatccaagaccctgggaaggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 3874 - DNA, 201 bp, Homo sapiens; identical to SEQ ID NO: 3628

SEQ ID NO: 3875 - DNA, 201 bp, Homo sapiens; identical to SEQ ID NO: 3818

SEQ ID NO: 3876 - DNA, 201 bp, Homo sapiens; identical to SEQ ID NO: 3658

SEQ ID NO: 3877 - DNA, 201 bp, Homo sapiens; identical to SEQ ID NO: 3750

SEQ ID NO: 3878 - DNA, 201 bp, Homo sapiens; identical to SEQ ID NO: 3660

SEQ ID NO: 3879 - DNA, 201 bp, Homo sapiens; identical to SEQ ID NO: 3661

SEQ ID NO: 3880 - DNA, 201 bp, Homo sapiens; identical to SEQ ID NO: 3662

SEQ ID NO: 3881 - DNA, 201 bp, Homo sapiens
gaccctgggaaggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagttgcagcatgccattgggaatggagagtaaagcaatatcagat

SEQ ID NO: 3882 - DNA, 201 bp, Homo sapiens; identical to SEQ ID NO: 3524

SEQ ID NO: 3883 - DNA, 156 bp, Homo sapiens
cgggctgccgccgtgcccgcgccggctccccagcccgagcctgccccttgccctgrtgaggtgcaaagagcgggatcggaggcggggcctggccgggctgtgagcggcgtatgcaaatcgagggtctcggggatgcggatccaagaccctgggaag

SEQ ID NO: 3884 - DNA, 201 bp, Homo sapiens; identical to SEQ ID NO: 3565

SEQ ID NO: 3885 - DNA, 201 bp, Homo sapiens; identical to SEQ ID NO: 3641

SEQ ID NO: 3886 - DNA, 201 bp, Homo sapiens; identical to SEQ ID NO: 3642

SEQ ID NO: 3887 - DNA, 201 bp, Homo sapiens; identical to SEQ ID NO: 3713

SEQ ID NO: 3888 - DNA, 201 bp, Homo sapiens
ggtctcggggatgcggatccaagaccctgggaaggtcttctttggcaatgtggattcatctgggataaaacacaatatttttaaccctccaattattgctygatacatccgtttgcacccaactcattatagcattcgcagcactcttcgcatggagttgatgggctgtgatttaaatagttgcagcatgccattgggaat

SEQ ID NO: 3889 - DNA, 201 bp, Homo sapiens; identical to SEQ ID NO: 3603

SEQ ID NO: 3890 - DNA, 201 bp, Homo sapiens; identical to SEQ ID NO: 3481

SEQ ID NO: 3891 - DNA, 201 bp, Homo sapiens; identical to SEQ ID NO: 3482

SEQ ID NO: 3892 - DNA, 201 bp, Homo sapiens; identical to SEQ ID NO: 3483

SEQ ID NO: 3893 - DNA, 201 bp, Homo sapiens; identical to SEQ ID NO: 3484

SEQ ID NO: 3894 - DNA, 201 bp, Homo sapiens; identical to SEQ ID NO: 3485

SEQ ID NO: 3895 - DNA, 201 bp, Homo sapiens; identical to SEQ ID NO: 3486

SEQ ID NO: 3896 - DNA, 201 bp, Homo sapiens; identical to SEQ ID NO: 3487

SEQ ID NO: 3897 - DNA, 201 bp, Homo sapiens; identical to SEQ ID NO: 3488

SEQ ID NO: 3898 - DNA, 201 bp, Homo sapiens; identical to SEQ ID NO: 3489

SEQ ID NO: 3899 - DNA, 201 bp, Homo sapiens; identical to SEQ ID NO: 3490

SEQ ID NO: 3900 - DNA, 201 bp, Homo sapiens; identical to SEQ ID NO: 3491

SEQ ID NO: 3901 - DNA, 201 bp, Homo sapiens; identical to SEQ ID NO: 3492

SEQ ID NO: 3902 - DNA, 201 bp, Homo sapiens; identical to SEQ ID NO: 3493

SEQ ID NO: 3903 - DNA, 201 bp, Homo sapiens; identical to SEQ ID NO: 3494

SEQ ID NO: 3904 - DNA, 201 bp, Homo sapiens; identical to SEQ ID NO: 3495

SEQ ID NO: 3905 - DNA, 201 bp, Homo sapiens; identical to SEQ ID NO: 3496

SEQ ID NO: 3906 - DNA, 201 bp, Homo sapiens; identical to SEQ ID NO: 3497

SEQ ID NO: 3907 - DNA, 201 bp, Homo sapiens; identical to SEQ ID NO: 3498

SEQ ID NO: 3908 - DNA, 201 bp, Homo sapiens; identical to SEQ ID NO: 3499

SEQ ID NO: 3909 - DNA, 201 bp, Homo sapiens; identical to SEQ ID NO: 3500

SEQ ID NO: 3910 - DNA, 201 bp, Homo sapiens; identical to SEQ ID NO: 3501

SEQ ID NO: 3911 - DNA, 201 bp, Homo sapiens; identical to SEQ ID NO: 3502

SEQ ID NO: 3912 - DNA, 201 bp, Homo sapiens; identical to SEQ ID NO: 3503

SEQ ID NO: 3913 - DNA, 201 bp, Homo sapiens; identical to SEQ ID NO: 3504

SEQ ID NO: 3914 - DNA, 201 bp, Homo sapiens; identical to SEQ ID NO: 3505

SEQ ID NO: 3915 - DNA, 201 bp, Homo sapiens; identical to SEQ ID NO: 3506

SEQ ID NO: 3916 - DNA, 201 bp, Homo sapiens; identical to SEQ ID NO: 3507

SEQ ID NO: 3917 - DNA, 201 bp, Homo sapiens; identical to SEQ ID NO: 3508

SEQ ID NO: 3918 - DNA, 201 bp, Homo sapiens; identical to SEQ ID NO: 3509

SEQ ID NO: 3919 - DNA, 201 bp, Homo sapiens; identical to SEQ ID NO: 3510

SEQ ID NO: 3920 - DNA, 201 bp, Homo sapiens; identical to SEQ ID NO: 3511

SEQ ID NO: 3921 - DNA, 201 bp, Homo sapiens; identical to SEQ ID NO: 3512

SEQ ID NO: 3922 - DNA, 201 bp, Homo sapiens; identical to SEQ ID NO: 3513

SEQ ID NO: 3923 - DNA, 201 bp, Homo sapiens; identical to SEQ ID NO: 3514

SEQ ID NO: 3924 - DNA, 201 bp, Homo sapiens; identical to SEQ ID NO: 3515

SEQ ID NO: 3925 - DNA, 201 bp, Homo sapiens; identical to SEQ ID NO: 3516

SEQ ID NO: 3926 - DNA, 201 bp, Homo sapiens; identical to SEQ ID NO: 3517

SEQ ID NO: 3927 - DNA, 201 bp, Homo sapiens; identical to SEQ ID NO: 3518

SEQ ID NO: 3928 - DNA, 201 bp, Homo sapiens; identical to SEQ ID NO: 3519

SEQ ID NO: 3929 - DNA, 201 bp, Homo sapiens; identical to SEQ ID NO: 3520

SEQ ID NO: 3930 - DNA, 201 bp, Homo sapiens; identical to SEQ ID NO: 3521

SEQ ID NO: 3931 - DNA, 201 bp, Homo sapiens; identical to SEQ ID NO: 3522

SEQ ID NO: 3932 - DNA, 201 bp, Homo sapiens; identical to SEQ ID NO: 3523

SEQ ID NO: 3933 - DNA, 201 bp, Homo sapiens; identical to SEQ ID NO: 3524

SEQ ID NO: 3934 - DNA, 201 bp, Homo sapiens; identical to SEQ ID NO: 3525

SEQ ID NO: 3935 - DNA, 201 bp, Homo sapiens; identical to SEQ ID NO: 3526

SEQ ID NO: 3936 - DNA, 201 bp, Homo sapiens; identical to SEQ ID NO: 3527

SEQ ID NO: 3937 - DNA, 201 bp, Homo sapiens; identical to SEQ ID NO: 3528

SEQ ID NO: 3938 - DNA, 201 bp, Homo sapiens; identical to SEQ ID NO: 3529

SEQ ID NO: 3939 - DNA, 201 bp, Homo sapiens; identical to SEQ ID NO: 3530

SEQ ID NO: 3940 - DNA, 201 bp, Homo sapiens; identical to SEQ ID NO: 3531

SEQ ID NO: 3941 - DNA, 201 bp, Homo sapiens; identical to SEQ ID NO: 3532

SEQ ID NO: 3942 - DNA, 201 bp, Homo sapiens; identical to SEQ ID NO: 3533

SEQ ID NO: 3943 - DNA, 201 bp, Homo sapiens; identical to SEQ ID NO: 3534

SEQ ID NO: 3944 - DNA, 201 bp, Homo sapiens; identical to SEQ ID NO: 3535

SEQ ID NO: 3945 - DNA, 201 bp, Homo sapiens; identical to SEQ ID NO: 3536

SEQ ID NO: 3946 - DNA, 201 bp, Homo sapiens; identical to SEQ ID NO: 3537

SEQ ID NO: 3947 - DNA, 201 bp, Homo sapiens; identical to SEQ ID NO: 3538

SEQ ID NO: 3948 - DNA, 201 bp, Homo sapiens; identical to SEQ ID NO: 3539

SEQ ID NO: 3949 - DNA, 201 bp, Homo sapiens; identical to SEQ ID NO: 3540

SEQ ID NO: 3950 - DNA, 201 bp, Homo sapiens; identical to SEQ ID NO: 3541

SEQ ID NO: 3951 - DNA, 201 bp, Homo sapiens; identical to SEQ ID NO: 3542

SEQ ID NO: 3952 - DNA, 201 bp, Homo sapiens; identical to SEQ ID NO: 3543

SEQ ID NO: 3953 - DNA, 201 bp, Homo sapiens; identical to SEQ ID NO: 3544

SEQ ID NO: 3954 - DNA, 201 bp, Homo sapiens; identical to SEQ ID NO: 3545

SEQ ID NO: 3955 - DNA, 201 bp, Homo sapiens; identical to SEQ ID NO: 3546

SEQ ID NO: 3956 - DNA, 201 bp, Homo sapiens; identical to SEQ ID NO: 3547

SEQ ID NO: 3957 - DNA, 201 bp, Homo sapiens; identical to SEQ ID NO: 3548

SEQ ID NO: 3958 - DNA, 201 bp, Homo sapiens; identical to SEQ ID NO: 3549

SEQ ID NO: 3959 - DNA, 201 bp, Homo sapiens; identical to SEQ ID NO: 3550

SEQ ID NO: 3960 - DNA, 201 bp, Homo sapiens; identical to SEQ ID NO: 3551

SEQ ID NO: 3961 - DNA, 201 bp, Homo sapiens; identical to SEQ ID NO: 3552

SEQ ID NO: 3962 - DNA, 201 bp, Homo sapiens; identical to SEQ ID NO: 3553

SEQ ID NO: 3963 - DNA, 201 bp, Homo sapiens; identical to SEQ ID NO: 3554

SEQ ID NO: 3964 - DNA, 201 bp, Homo sapiens; identical to SEQ ID NO: 3555

SEQ ID NO: 3965 - DNA, 201 bp, Homo sapiens; identical to SEQ ID NO: 3556

SEQ ID NO: 3966 - DNA, 201 bp, Homo sapiens; identical to SEQ ID NO: 3557

SEQ ID NO: 3967 - DNA, 201 bp, Homo sapiens; identical to SEQ ID NO: 3558

SEQ ID NO: 3968 - DNA, 201 bp, Homo sapiens; identical to SEQ ID NO: 3559

SEQ ID NO: 3969 - DNA, 201 bp, Homo sapiens; identical to SEQ ID NO: 3560

SEQ ID NO: 3970 - DNA, 201 bp, Homo sapiens; identical to SEQ ID NO: 3561

SEQ ID NO: 3971 - DNA, 201 bp, Homo sapiens; identical to SEQ ID NO: 3562

SEQ ID NO: 3972 - DNA, 201 bp, Homo sapiens; identical to SEQ ID NO: 3563

SEQ ID NO: 3973 - DNA, 201 bp, Homo sapiens; identical to SEQ ID NO: 3564

SEQ ID NO: 3974 - DNA, 201 bp, Homo sapiens; identical to SEQ ID NO: 3565

SEQ ID NO: 3975 - DNA, 201 bp, Homo sapiens; identical to SEQ ID NO: 3566

SEQ ID NO: 3976 - DNA, 201 bp, Homo sapiens; identical to SEQ ID NO: 3567

SEQ ID NO: 3977 - DNA, 201 bp, Homo sapiens; identical to SEQ ID NO: 3568

SEQ ID NO: 3978 - DNA, 201 bp, Homo sapiens; identical to SEQ ID NO: 3569

SEQ ID NO: 3979 - DNA, 201 bp, Homo sapiens; identical to SEQ ID NO: 3570

SEQ ID NO: 3980 - DNA, 201 bp, Homo sapiens; identical to SEQ ID NO: 3571

SEQ ID NO: 3981 - DNA, 201 bp, Homo sapiens; identical to SEQ ID NO: 3572

SEQ ID NO: 3982 - DNA, 201 bp, Homo sapiens; identical to SEQ ID NO: 3573

SEQ ID NO: 3983 - DNA, 201 bp, Homo sapiens; identical to SEQ ID NO: 3574

SEQ ID NO: 3984 - DNA, 201 bp, Homo sapiens; identical to SEQ ID NO: 3575

SEQ ID NO: 3985 - DNA, 201 bp, Homo sapiens; identical to SEQ ID NO: 3576

SEQ ID NO: 3986 - DNA, 201 bp, Homo sapiens; identical to SEQ ID NO: 3577

SEQ ID NO: 3987 - DNA, 201 bp, Homo sapiens; identical to SEQ ID NO: 3578

SEQ ID NO: 3988 - DNA, 201 bp, Homo sapiens; identical to SEQ ID NO: 3579

SEQ ID NO: 3989 - DNA, 201 bp, Homo sapiens; identical to SEQ ID NO: 3580

SEQ ID NO: 3990 - DNA, 201 bp, Homo sapiens; identical to SEQ ID NO: 3581

SEQ ID NO: 3991 - DNA, 201 bp, Homo sapiens; identical to SEQ ID NO: 3583

SEQ ID NO: 3992 - DNA, 201 bp, Homo sapiens; identical to SEQ ID NO: 3582

SEQ ID NO: 3993 - DNA, 201 bp, Homo sapiens; identical to SEQ ID NO: 3584

SEQ ID NO: 3994 - DNA, 201 bp, Homo sapiens; identical to SEQ ID NO: 3585

SEQ ID NO: 3995 - DNA, 201 bp, Homo sapiens; identical to SEQ ID NO: 3586

SEQ ID NO: 3996 - DNA, 201 bp, Homo sapiens; identical to SEQ ID NO: 3588

SEQ ID NO: 3997 - DNA, 201 bp, Homo sapiens
cctaagtcttgatgggaagaagtggcagacttatcgaggaaattccactggaaccttaatggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 3998 - DNA, 201 bp, Homo sapiens; identical to SEQ ID NO: 3589

SEQ ID NO: 3999 - DNA, 201 bp, Homo sapiens; identical to SEQ ID NO: 3590

SEQ ID NO: 4000 - DNA, 201 bp, Homo sapiens; identical to SEQ ID NO: 3591

SEQ ID NO: 4001 - DNA, 201 bp, Homo sapiens; identical to SEQ ID NO: 3592

SEQ ID NO: 4002 - DNA, 201 bp, Homo sapiens; identical to SEQ ID NO: 3593

SEQ ID NO: 4003 - DNA, 201 bp, Homo sapiens; identical to SEQ ID NO: 3594

SEQ ID NO: 4004 - DNA, 201 bp, Homo sapiens; identical to SEQ ID NO: 3595

SEQ ID NO: 4005 - DNA, 201 bp, Homo sapiens; identical to SEQ ID NO: 3596

SEQ ID NO: 4006 - DNA, 201 bp, Homo sapiens; identical to SEQ ID NO: 3597

SEQ ID NO: 4007 - DNA, 201 bp, Homo sapiens; identical to SEQ ID NO: 3598

SEQ ID NO: 4008 - DNA, 201 bp, Homo sapiens; identical to SEQ ID NO: 3599

SEQ ID NO: 4009 - DNA, 201 bp, Homo sapiens; identical to SEQ ID NO: 3600

SEQ ID NO: 4010 - DNA, 201 bp, Homo sapiens; identical to SEQ ID NO: 3601

SEQ ID NO: 4011 - DNA, 201 bp, Homo sapiens; identical to SEQ ID NO: 3602

SEQ ID NO: 4012 - DNA, 201 bp, Homo sapiens; identical to SEQ ID NO: 3603

SEQ ID NO: 4013 - DNA, 201 bp, Homo sapiens; identical to SEQ ID NO: 3604

SEQ ID NO: 4014 - DNA, 201 bp, Homo sapiens; identical to SEQ ID NO: 3605

SEQ ID NO: 4015 - DNA, 201 bp, Homo sapiens; identical to SEQ ID NO: 3606

SEQ ID NO: 4016 - DNA, 201 bp, Homo sapiens; identical to SEQ ID NO: 3607

SEQ ID NO: 4017 - DNA, 201 bp, Homo sapiens; identical to SEQ ID NO: 3608

SEQ ID NO: 4018 - DNA, 201 bp, Homo sapiens; identical to SEQ ID NO: 3609

SEQ ID NO: 4019 - DNA, 201 bp, Homo sapiens; identical to SEQ ID NO: 3610

SEQ ID NO: 4020 - DNA, 201 bp, Homo sapiens; identical to SEQ ID NO: 3611

SEQ ID NO: 4021 - DNA, 201 bp, Homo sapiens; identical to SEQ ID NO: 3612

SEQ ID NO: 4022 - DNA, 201 bp, Homo sapiens; identical to SEQ ID NO: 3613

SEQ ID NO: 4023 - DNA, 201 bp, Homo sapiens; identical to SEQ ID NO: 3614

SEQ ID NO: 4024 - DNA, 201 bp, Homo sapiens; identical to SEQ ID NO: 3615

SEQ ID NO: 4025 - DNA, 201 bp, Homo sapiens; identical to SEQ ID NO: 3616

SEQ ID NO: 4026 - DNA, 201 bp, Homo sapiens; identical to SEQ ID NO: 3617

SEQ ID NO: 4027 - DNA, 201 bp, Homo sapiens; identical to SEQ ID NO: 3618

SEQ ID NO: 4028 - DNA, 201 bp, Homo sapiens; identical to SEQ ID NO: 3619

SEQ ID NO: 4029 - DNA, 201 bp, Homo sapiens; identical to SEQ ID NO: 3620

SEQ ID NO: 4030 - DNA, 201 bp, Homo sapiens; identical to SEQ ID NO: 3621

SEQ ID NO: 4031 - DNA, 201 bp, Homo sapiens; identical to SEQ ID NO: 3622

SEQ ID NO: 4032 - DNA, 201 bp, Homo sapiens; identical to SEQ ID NO: 3623

SEQ ID NO: 4033 - DNA, 201 bp, Homo sapiens; identical to SEQ ID NO: 3624

SEQ ID NO: 4034 - DNA, 201 bp, Homo sapiens; identical to SEQ ID NO: 3625

SEQ ID NO: 4035 - DNA, 201 bp, Homo sapiens; identical to SEQ ID NO: 3626

SEQ ID NO: 4036 - DNA, 201 bp, Homo sapiens; identical to SEQ ID NO: 3627

SEQ ID NO: 4037 - DNA, 201 bp, Homo sapiens; identical to SEQ ID NO: 3628

SEQ ID NO: 4038 - DNA, 201 bp, Homo sapiens; identical to SEQ ID NO: 3629

SEQ ID NO: 4039 - DNA, 201 bp, Homo sapiens; identical to SEQ ID NO: 3630

SEQ ID NO: 4040 - DNA, 201 bp, Homo sapiens; identical to SEQ ID NO: 3631

SEQ ID NO: 4041 - DNA, 201 bp, Homo sapiens; identical to SEQ ID NO: 3632

SEQ ID NO: 4042 - DNA, 201 bp, Homo sapiens; identical to SEQ ID NO: 3633

SEQ ID NO: 4043 - DNA, 201 bp, Homo sapiens; identical to SEQ ID NO: 3634

SEQ ID NO: 4044 - DNA, 201 bp, Homo sapiens; identical to SEQ ID NO: 3635

SEQ ID NO: 4045 - DNA, 201 bp, Homo sapiens; identical to SEQ ID NO: 3636

SEQ ID NO: 4046 - DNA, 201 bp, Homo sapiens; identical to SEQ ID NO: 3637

SEQ ID NO: 4047 - DNA, 201 bp, Homo sapiens; identical to SEQ ID NO: 3638

SEQ ID NO: 4048 - DNA, 201 bp, Homo sapiens; identical to SEQ ID NO: 3639

SEQ ID NO: 4049 - DNA, 201 bp, Homo sapiens; identical to SEQ ID NO: 3640

SEQ ID NO: 4050 - DNA, 201 bp, Homo sapiens; identical to SEQ ID NO: 3641

SEQ ID NO: 4051 - DNA, 201 bp, Homo sapiens; identical to SEQ ID NO: 3642

SEQ ID NO: 4052 - DNA, 201 bp, Homo sapiens; identical to SEQ ID NO: 3643

SEQ ID NO: 4053 - DNA, 201 bp, Homo sapiens; identical to SEQ ID NO: 3644

SEQ ID NO: 4054 - DNA, 201 bp, Homo sapiens; identical to SEQ ID NO: 3646

SEQ ID NO: 4055 - DNA, 201 bp, Homo sapiens; identical to SEQ ID NO: 3645

SEQ ID NO: 4056 - DNA, 201 bp, Homo sapiens; identical to SEQ ID NO: 3647

SEQ ID NO: 4057 - DNA, 201 bp, Homo sapiens; identical to SEQ ID NO: 3648

SEQ ID NO: 4058 - DNA, 201 bp, Homo sapiens; identical to SEQ ID NO: 3649

SEQ ID NO: 4059 - DNA, 201 bp, Homo sapiens; identical to SEQ ID NO: 3650

SEQ ID NO: 4060 - DNA, 201 bp, Homo sapiens; identical to SEQ ID NO: 3651

SEQ ID NO: 4061 - DNA, 201 bp, Homo sapiens; identical to SEQ ID NO: 3652

SEQ ID NO: 4062 - DNA, 201 bp, Homo sapiens; identical to SEQ ID NO: 3653

SEQ ID NO: 4063 - DNA, 201 bp, Homo sapiens; identical to SEQ ID NO: 3654

SEQ ID NO: 4064 - DNA, 201 bp, Homo sapiens; identical to SEQ ID NO: 3655

SEQ ID NO: 4065 - DNA, 201 bp, Homo sapiens; identical to SEQ ID NO: 3656

SEQ ID NO: 4066 - DNA, 201 bp, Homo sapiens; identical to SEQ ID NO: 3657

SEQ ID NO: 4067 - DNA, 201 bp, Homo sapiens; identical to SEQ ID NO: 3658

SEQ ID NO: 4068 - DNA, 201 bp, Homo sapiens; identical to SEQ ID NO: 3659

SEQ ID NO: 4069 - DNA, 201 bp, Homo sapiens; identical to SEQ ID NO: 3660

SEQ ID NO: 4070 - DNA, 201 bp, Homo sapiens; identical to SEQ ID NO: 3661

SEQ ID NO: 4071 - DNA, 201 bp, Homo sapiens; identical to SEQ ID NO: 3662

SEQ ID NO: 4072 - DNA, 201 bp, Homo sapiens; identical to SEQ ID NO: 3663

SEQ ID NO: 4073 - DNA, 201 bp, Homo sapiens; identical to SEQ ID NO: 3664

SEQ ID NO: 4074 - DNA, 201 bp, Homo sapiens; identical to SEQ ID NO: 3665

SEQ ID NO: 4075 - DNA, 201 bp, Homo sapiens; identical to SEQ ID NO: 3666

SEQ ID NO: 4076 - DNA, 201 bp, Homo sapiens; identical to SEQ ID NO: 3667

SEQ ID NO: 4077 - DNA, 201 bp, Homo sapiens; identical to SEQ ID NO: 3668

SEQ ID NO: 4078 - DNA, 201 bp, Homo sapiens; identical to SEQ ID NO: 3669

SEQ ID NO: 4079 - DNA, 201 bp, Homo sapiens; identical to SEQ ID NO: 3670

SEQ ID NO: 4080 - DNA, 201 bp, Homo sapiens; identical to SEQ ID NO: 3671

SEQ ID NO: 4081 - DNA, 201 bp, Homo sapiens; identical to SEQ ID NO: 3672

SEQ ID NO: 4082 - DNA, 201 bp, Homo sapiens; identical to SEQ ID NO: 3673

SEQ ID NO: 4083 - DNA, 201 bp, Homo sapiens; identical to SEQ ID NO: 3674

SEQ ID NO: 4084 - DNA, 201 bp, Homo sapiens; identical to SEQ ID NO: 3675

SEQ ID NO: 4085 - DNA, 201 bp, Homo sapiens; identical to SEQ ID NO: 3676

SEQ ID NO: 4086 - DNA, 201 bp, Homo sapiens; identical to SEQ ID NO: 3677

SEQ ID NO: 4087 - DNA, 201 bp, Homo sapiens; identical to SEQ ID NO: 3678

SEQ ID NO: 4088 - DNA, 201 bp, Homo sapiens; identical to SEQ ID NO: 3679

SEQ ID NO: 4089 - DNA, 201 bp, Homo sapiens; identical to SEQ ID NO: 3680

SEQ ID NO: 4090 - DNA, 201 bp, Homo sapiens; identical to SEQ ID NO: 3681

SEQ ID NO: 4091 - DNA, 201 bp, Homo sapiens; identical to SEQ ID NO: 3682

SEQ ID NO: 4092 - DNA, 201 bp, Homo sapiens; identical to SEQ ID NO: 3683

SEQ ID NO: 4093 - DNA, 201 bp, Homo sapiens; identical to SEQ ID NO: 3685

SEQ ID NO: 4094 - DNA, 201 bp, Homo sapiens; identical to SEQ ID NO: 3684

SEQ ID NO: 4095 - DNA, 201 bp, Homo sapiens; identical to SEQ ID NO: 3687

SEQ ID NO: 4096 - DNA, 201 bp, Homo sapiens; identical to SEQ ID NO: 3686

SEQ ID NO: 4097 - DNA, 201 bp, Homo sapiens; identical to SEQ ID NO: 3688

SEQ ID NO: 4098 - DNA, 201 bp, Homo sapiens; identical to SEQ ID NO: 3689

SEQ ID NO: 4099 - DNA, 201 bp, Homo sapiens; identical to SEQ ID NO: 3690

SEQ ID NO: 4100 - DNA, 201 bp, Homo sapiens; identical to SEQ ID NO: 3691

SEQ ID NO: 4101 - DNA, 201 bp, Homo sapiens; identical to SEQ ID NO: 3692

SEQ ID NO: 4102 - DNA, 201 bp, Homo sapiens; identical to SEQ ID NO: 3693

SEQ ID NO: 4103 - DNA, 201 bp, Homo sapiens; identical to SEQ ID NO: 3694

SEQ ID NO: 4104 - DNA, 201 bp, Homo sapiens; identical to SEQ ID NO: 3695

SEQ ID NO: 4105 - DNA, 201 bp, Homo sapiens; identical to SEQ ID NO: 3696

SEQ ID NO: 4106 - DNA, 201 bp, Homo sapiens; identical to SEQ ID NO: 3697

SEQ ID NO: 4107 - DNA, 201 bp, Homo sapiens; identical to SEQ ID NO: 3698

SEQ ID NO: 4108 - DNA, 201 bp, Homo sapiens; identical to SEQ ID NO: 3699

SEQ ID NO: 4109 - DNA, 201 bp, Homo sapiens; identical to SEQ ID NO: 3700

SEQ ID NO: 4110 - DNA, 201 bp, Homo sapiens; identical to SEQ ID NO: 3701

SEQ ID NO: 4111 - DNA, 201 bp, Homo sapiens; identical to SEQ ID NO: 3702

SEQ ID NO: 4112 - DNA, 201 bp, Homo sapiens; identical to SEQ ID NO: 3703

SEQ ID NO: 4113 - DNA, 201 bp, Homo sapiens; identical to SEQ ID NO: 3704

SEQ ID NO: 4114 - DNA, 201 bp, Homo sapiens; identical to SEQ ID NO: 3705

SEQ ID NO: 4115 - DNA, 201 bp, Homo sapiens; identical to SEQ ID NO: 3706

SEQ ID NO: 4116 - DNA, 201 bp, Homo sapiens; identical to SEQ ID NO: 3707

SEQ ID NO: 4117 - DNA, 201 bp, Homo sapiens; identical to SEQ ID NO: 3708

SEQ ID NO: 4118 - DNA, 201 bp, Homo sapiens; identical to SEQ ID NO: 3709

SEQ ID NO: 4119 - DNA, 201 bp, Homo sapiens; identical to SEQ ID NO: 3710

SEQ ID NO: 4120 - DNA, 201 bp, Homo sapiens; identical to SEQ ID NO: 3711

SEQ ID NO: 4121 - DNA, 201 bp, Homo sapiens; identical to SEQ ID NO: 3712

SEQ ID NO: 4122 - DNA, 201 bp, Homo sapiens; identical to SEQ ID NO: 3713

SEQ ID NO: 4123 - DNA, 201 bp, Homo sapiens; identical to SEQ ID NO: 3714

SEQ ID NO: 4124 - DNA, 201 bp, Homo sapiens; identical to SEQ ID NO: 3715

SEQ ID NO: 4125 - DNA, 201 bp, Homo sapiens; identical to SEQ ID NO: 3716

SEQ ID NO: 4126 - DNA, 201 bp, Homo sapiens; identical to SEQ ID NO: 3717

SEQ ID NO: 4127 - DNA, 201 bp, Homo sapiens; identical to SEQ ID NO: 3718

SEQ ID NO: 4128 - DNA, 201 bp, Homo sapiens; identical to SEQ ID NO: 3719

SEQ ID NO: 4129 - DNA, 201 bp, Homo sapiens; identical to SEQ ID NO: 3720

SEQ ID NO: 4130 - DNA, 201 bp, Homo sapiens; identical to SEQ ID NO: 3721

SEQ ID NO: 4131 - DNA, 201 bp, Homo sapiens; identical to SEQ ID NO: 3722

SEQ ID NO: 4132 - DNA, 201 bp, Homo sapiens; identical to SEQ ID NO: 3723

SEQ ID NO: 4133 - DNA, 201 bp, Homo sapiens; identical to SEQ ID NO: 3724

SEQ ID NO: 4134 - DNA, 201 bp, Homo sapiens; identical to SEQ ID NO: 3725

SEQ ID NO: 4135 - DNA, 201 bp, Homo sapiens; identical to SEQ ID NO: 3726

SEQ ID NO: 4136 - DNA, 201 bp, Homo sapiens; identical to SEQ ID NO: 3727

SEQ ID NO: 4137 - DNA, 201 bp, Homo sapiens; identical to SEQ ID NO: 3728

SEQ ID NO: 4138 - DNA, 201 bp, Homo sapiens; identical to SEQ ID NO: 3729

SEQ ID NO: 4139 - DNA, 201 bp, Homo sapiens; identical to SEQ ID NO: 3730

SEQ ID NO: 4140 - DNA, 201 bp, Homo sapiens; identical to SEQ ID NO: 3731

SEQ ID NO: 4141 - DNA, 201 bp, Homo sapiens; identical to SEQ ID NO: 3732

SEQ ID NO: 4142 - DNA, 201 bp, Homo sapiens; identical to SEQ ID NO: 3733

SEQ ID NO: 4143 - DNA, 201 bp, Homo sapiens; identical to SEQ ID NO: 3734

SEQ ID NO: 4144 - DNA, 201 bp, Homo sapiens; identical to SEQ ID NO: 3735

SEQ ID NO: 4145 - DNA, 201 bp, Homo sapiens; identical to SEQ ID NO: 3736

SEQ ID NO: 4146 - DNA, 201 bp, Homo sapiens; identical to SEQ ID NO: 3737

SEQ ID NO: 4147 - DNA, 201 bp, Homo sapiens; identical to SEQ ID NO: 3738

SEQ ID NO: 4148 - DNA, 201 bp, Homo sapiens; identical to SEQ ID NO: 3739

SEQ ID NO: 4149 - DNA, 201 bp, Homo sapiens; identical to SEQ ID NO: 3740

SEQ ID NO: 4150 - DNA, 201 bp, Homo sapiens; identical to SEQ ID NO: 3741

SEQ ID NO: 4151 - DNA, 201 bp, Homo sapiens; identical to SEQ ID NO: 3742

SEQ ID NO: 4152 - DNA, 201 bp, Homo sapiens; identical to SEQ ID NO: 3743

SEQ ID NO: 4153 - DNA, 201 bp, Homo sapiens; identical to SEQ ID NO: 3744

SEQ ID NO: 4154 - DNA, 201 bp, Homo sapiens; identical to SEQ ID NO: 3745

SEQ ID NO: 4155 - DNA, 201 bp, Homo sapiens; identical to SEQ ID NO: 3746

SEQ ID NO: 4156 - DNA, 201 bp, Homo sapiens; identical to SEQ ID NO: 3747

SEQ ID NO: 4157 - DNA, 201 bp, Homo sapiens; identical to SEQ ID NO: 3748

SEQ ID NO: 4158 - DNA, 201 bp, Homo sapiens; identical to SEQ ID NO: 3749

SEQ ID NO: 4159 - DNA, 201 bp, Homo sapiens; identical to SEQ ID NO: 3750

SEQ ID NO: 4160 - DNA, 201 bp, Homo sapiens; identical to SEQ ID NO: 3751

SEQ ID NO: 4161 - DNA, 201 bp, Homo sapiens; identical to SEQ ID NO: 3752

SEQ ID NO: 4162 - DNA, 201 bp, Homo sapiens; identical to SEQ ID NO: 3753

SEQ ID NO: 4163 - DNA, 201 bp, Homo sapiens; identical to SEQ ID NO: 3754

SEQ ID NO: 4164 - DNA, 201 bp, Homo sapiens; identical to SEQ ID NO: 3755

SEQ ID NO: 4165 - DNA, 201 bp, Homo sapiens; identical to SEQ ID NO: 3756

SEQ ID NO: 4166 - DNA, 201 bp, Homo sapiens; identical to SEQ ID NO: 3757

SEQ ID NO: 4167 - DNA, 201 bp, Homo sapiens; identical to SEQ ID NO: 3758

SEQ ID NO: 4168 - DNA, 201 bp, Homo sapiens; identical to SEQ ID NO: 3759

SEQ ID NO: 4169 - DNA, 201 bp, Homo sapiens; identical to SEQ ID NO: 3760

SEQ ID NO: 4170 - DNA, 201 bp, Homo sapiens; identical to SEQ ID NO: 3761

SEQ ID NO: 4171 - DNA, 201 bp, Homo sapiens; identical to SEQ ID NO: 3762

SEQ ID NO: 4172 - DNA, 201 bp, Homo sapiens; identical to SEQ ID NO: 3763

SEQ ID NO: 4173 - DNA, 201 bp, Homo sapiens; identical to SEQ ID NO: 3764

SEQ ID NO: 4174 - DNA, 201 bp, Homo sapiens; identical to SEQ ID NO: 3765

SEQ ID NO: 4175 - DNA, 201 bp, Homo sapiens; identical to SEQ ID NO: 3766

SEQ ID NO: 4176 - DNA, 201 bp, Homo sapiens; identical to SEQ ID NO: 3767

SEQ ID NO: 4177 - DNA, 201 bp, Homo sapiens; identical to SEQ ID NO: 3768

SEQ ID NO: 4178 - DNA, 201 bp, Homo sapiens; identical to SEQ ID NO: 3769

SEQ ID NO: 4179 - DNA, 201 bp, Homo sapiens; identical to SEQ ID NO: 3770

SEQ ID NO: 4180 - DNA, 201 bp, Homo sapiens; identical to SEQ ID NO: 3771

SEQ ID NO: 4181 - DNA, 201 bp, Homo sapiens; identical to SEQ ID NO: 3772

SEQ ID NO: 4182 - DNA, 201 bp, Homo sapiens; identical to SEQ ID NO: 3773

SEQ ID NO: 4183 - DNA, 201 bp, Homo sapiens; identical to SEQ ID NO: 3774

SEQ ID NO: 4184 - DNA, 201 bp, Homo sapiens; identical to SEQ ID NO: 3775

SEQ ID NO: 4185 - DNA, 201 bp, Homo sapiens; identical to SEQ ID NO: 3776

SEQ ID NO: 4186 - DNA, 201 bp, Homo sapiens; identical to SEQ ID NO: 3777

SEQ ID NO: 4187 - DNA, 201 bp, Homo sapiens; identical to SEQ ID NO: 3778

SEQ ID NO: 4188 - DNA, 201 bp, Homo sapiens; identical to SEQ ID NO: 3779

SEQ ID NO: 4189 - DNA, 201 bp, Homo sapiens; identical to SEQ ID NO: 3780

SEQ ID NO: 4190 - DNA, 201 bp, Homo sapiens; identical to SEQ ID NO: 3781

SEQ ID NO: 4191 - DNA, 201 bp, Homo sapiens; identical to SEQ ID NO: 3782

SEQ ID NO: 4192 - DNA, 201 bp, Homo sapiens; identical to SEQ ID NO: 3783

SEQ ID NO: 4193 - DNA, 201 bp, Homo sapiens; identical to SEQ ID NO: 3784

SEQ ID NO: 4194 - DNA, 201 bp, Homo sapiens; identical to SEQ ID NO: 3785

SEQ ID NO: 4195 - DNA, 201 bp, Homo sapiens; identical to SEQ ID NO: 3786

SEQ ID NO: 4196 - DNA, 201 bp, Homo sapiens; identical to SEQ ID NO: 3787

SEQ ID NO: 4197 - DNA, 201 bp, Homo sapiens; identical to SEQ ID NO: 3788

SEQ ID NO: 4198 - DNA, 201 bp, Homo sapiens; identical to SEQ ID NO: 3789

SEQ ID NO: 4199 - DNA, 201 bp, Homo sapiens; identical to SEQ ID NO: 3790

SEQ ID NO: 4200 - DNA, 201 bp, Homo sapiens; identical to SEQ ID NO: 3791

SEQ ID NO: 4201 - DNA, 201 bp, Homo sapiens; identical to SEQ ID NO: 3792

SEQ ID NO: 4202 - DNA, 201 bp, Homo sapiens; identical to SEQ ID NO: 3793

SEQ ID NO: 4203 - DNA, 201 bp, Homo sapiens; identical to SEQ ID NO: 3794

SEQ ID NO: 4204 - DNA, 201 bp, Homo sapiens; identical to SEQ ID NO: 3795

SEQ ID NO: 4205 - DNA, 201 bp, Homo sapiens; identical to SEQ ID NO: 3796

SEQ ID NO: 4206 - DNA, 201 bp, Homo sapiens; identical to SEQ ID NO: 3797

SEQ ID NO: 4207 - DNA, 201 bp, Homo sapiens; identical to SEQ ID NO: 3798

SEQ ID NO: 4208 - DNA, 201 bp, Homo sapiens; identical to SEQ ID NO: 3799

SEQ ID NO: 4209 - DNA, 201 bp, Homo sapiens; identical to SEQ ID NO: 3800

SEQ ID NO: 4210 - DNA, 201 bp, Homo sapiens; identical to SEQ ID NO: 3801

SEQ ID NO: 4211 - DNA, 201 bp, Homo sapiens; identical to SEQ ID NO: 3802

SEQ ID NO: 4212 - DNA, 201 bp, Homo sapiens; identical to SEQ ID NO: 3803

SEQ ID NO: 4213 - DNA, 201 bp, Homo sapiens; identical to SEQ ID NO: 3804

SEQ ID NO: 4214 - DNA, 201 bp, Homo sapiens; identical to SEQ ID NO: 3805

SEQ ID NO: 4215 - DNA, 201 bp, Homo sapiens; identical to SEQ ID NO: 3806

SEQ ID NO: 4216 - DNA, 201 bp, Homo sapiens; identical to SEQ ID NO: 3807

SEQ ID NO: 4217 - DNA, 201 bp, Homo sapiens; identical to SEQ ID NO: 3808

SEQ ID NO: 4218 - DNA, 201 bp, Homo sapiens; identical to SEQ ID NO: 3809

SEQ ID NO: 4219 - DNA, 201 bp, Homo sapiens; identical to SEQ ID NO: 3810

SEQ ID NO: 4220 - DNA, 201 bp, Homo sapiens; identical to SEQ ID NO: 3811

SEQ ID NO: 4221 - DNA, 201 bp, Homo sapiens; identical to SEQ ID NO: 3812

SEQ ID NO: 4222 - DNA, 201 bp, Homo sapiens; identical to SEQ ID NO: 3813

SEQ ID NO: 4223 - DNA, 201 bp, Homo sapiens; identical to SEQ ID NO: 3814

SEQ ID NO: 4224 - DNA, 201 bp, Homo sapiens; identical to SEQ ID NO: 3815

SEQ ID NO: 4225 - DNA, 201 bp, Homo sapiens; identical to SEQ ID NO: 3816

SEQ ID NO: 4226 - DNA, 201 bp, Homo sapiens; identical to SEQ ID NO: 3817

SEQ ID NO: 4227 - DNA, 201 bp, Homo sapiens; identical to SEQ ID NO: 3818

SEQ ID NO: 4228 - DNA, 201 bp, Homo sapiens; identical to SEQ ID NO: 3819

SEQ ID NO: 4229 - DNA, 201 bp, Homo sapiens; identical to SEQ ID NO: 3820

SEQ ID NO: 4230 - DNA, 201 bp, Homo sapiens; identical to SEQ ID NO: 3821

SEQ ID NO: 4231 - DNA, 201 bp, Homo sapiens; identical to SEQ ID NO: 3822

SEQ ID NO: 4232 - DNA, 201 bp, Homo sapiens; identical to SEQ ID NO: 3823

SEQ ID NO: 4233 - DNA, 201 bp, Homo sapiens; identical to SEQ ID NO: 3824

SEQ ID NO: 4234 - DNA, 201 bp, Homo sapiens; identical to SEQ ID NO: 3825

SEQ ID NO: 4235 - DNA, 201 bp, Homo sapiens; identical to SEQ ID NO: 3826

SEQ ID NO: 4236 - DNA, 201 bp, Homo sapiens; identical to SEQ ID NO: 3827

SEQ ID NO: 4237 - DNA, 201 bp, Homo sapiens; identical to SEQ ID NO: 3828

SEQ ID NO: 4238 - DNA, 201 bp, Homo sapiens; identical to SEQ ID NO: 3830

SEQ ID NO: 4239 - DNA, 201 bp, Homo sapiens; identical to SEQ ID NO: 3831

SEQ ID NO: 4240 - DNA, 201 bp, Homo sapiens; identical to SEQ ID NO: 3829

SEQ ID NO: 4241 - DNA, 201 bp, Homo sapiens; identical to SEQ ID NO: 3832

SEQ ID NO: 4242 - DNA, 201 bp, Homo sapiens; identical to SEQ ID NO: 3833

SEQ ID NO: 4243 - DNA, 201 bp, Homo sapiens; identical to SEQ ID NO: 3834

SEQ ID NO: 4244 - DNA, 201 bp, Homo sapiens; identical to SEQ ID NO: 3835

SEQ ID NO: 4245 - DNA, 201 bp, Homo sapiens; identical to SEQ ID NO: 3836

SEQ ID NO: 4246 - DNA, 201 bp, Homo sapiens; identical to SEQ ID NO: 3837

SEQ ID NO: 4247 - DNA, 201 bp, Homo sapiens; identical to SEQ ID NO: 3838

SEQ ID NO: 4248 - DNA, 201 bp, Homo sapiens; identical to SEQ ID NO: 3839

SEQ ID NO: 4249 - DNA, 201 bp, Homo sapiens; identical to SEQ ID NO: 3840

SEQ ID NO: 4250 - DNA, 201 bp, Homo sapiens
tactccaccactgtcacaggaagaacttgccaagcttggtcatctatgacaccacaccagcatagtcggaccccagaaaactacccaaatgctggcctgascaggaactactgcaggaatccagatgctgagattcgcccttggtgttacaccatggatcccagtgtcaggtgggagtactgcaacctgacacaatgcctg

SEQ ID NO: 4251 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaattactgccgtaaccctgatggtgacatcaatggtccctggtgctacacaatgaatccaa

SEQ ID NO: 4252 - DNA, 201 bp, Homo sapiens
caccggcatcagaggaccccagaaaactacccaaatgatggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 4253 - DNA, 201 bp, Homo sapiens
agggcctccttctgaacaagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaattactgccgtaaccctgatggtgacatcaatgg

SEQ ID NO: 4254 - DNA, 201 bp, Homo sapiens
cactgacagttgccagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 4255 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgctggcctgaccgagaactactgcaggaatccagattctgggaaacaaccctggtgttacacaaccgatcc

SEQ ID NO: 4256 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaagcaccaactgaaaacagcactggggtccaggactgctaccgagg

SEQ ID NO: 4257 - DNA, 201 bp, Homo sapiens
agtactgcaacctgacgcgatgctcagacacagaagggactgtggtcgctcctccgactgtcatccaggttccaagcctagggcctccttctgaacaagaytgtatgtttgggaatgggaaaggataccggggcaagaaggcaaccactgttactgggacgccatgccaggaatgggctgcccaggagccccatagacaca

SEQ ID NO: 4258 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaagcaccaactgaaaacagca

SEQ ID NO: 4259 - DNA, 201 bp, Homo sapiens
cccagttccaagcacagagcttccttctgaagaagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgctggcct

SEQ ID NO: 4260 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatggtggcctgaccaggaactactgcaggaatccagatgctgagattagtcct

SEQ ID NO: 4261 - DNA, 201 bp, Homo sapiens
cacaactcccacggtggtcccagttccaagcacagagcttccttctgaagaagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 4262 - DNA, 201 bp, Homo sapiens
aactcccacagtggccccggttccaagcacagaggctccttctgaacaagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 4263 - DNA, 201 bp, Homo sapiens
ctttttgactactgtgatatccctctctgtgcatcctcttcatttgattgtgggaagcctcaagtggagccgaagaaatgtcctggaagcattgtaggggkgtgtgtggcccacccacattcctggccctggcaagtcagtctcagaacaaggtttggaaagcacttctgtggaggcaccttaatatccccagagtgggtg

SEQ ID NO: 4264 - DNA, 201 bp, Homo sapiens
cgaggcacactctccaccactatcacaggaagaacatgtcagtcttggtcgtctatgacaccacattggcatcggaggatcccattatactatccaaatgrtggcctgaccaggaactactgcaggaatccagatgctgagattcgcccttggtgttacaccatggatcccagtgtcaggtgggagtactgcaacctgaca

SEQ ID NO: 4265 - DNA, 201 bp, Homo sapiens
ctgtggtcgctcctccgactgtcatccaggttccaagcctagggcctccttctgaacaagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 4266 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaagcaccaacggagcaaagccccggggtccaggattgctaccatggtgatggacagagttatcgaggctcattct

SEQ ID NO: 4267 - DNA, 201 bp, Homo sapiens
aaactttttgactactgtgatatccctctctgtgcatcctcttcatttgattgtgggaagcctcaagtggagccgaagaaatgtcctggaagcattgtagsggggtgtgtggcccacccacattcctggccctggcaagtcagtctcagaacaaggtttggaaagcacttctgtggaggcaccttaatatccccagagtgg

SEQ ID NO: 4268 - DNA, 201 bp, Homo sapiens
ccacagtccaggactgctaccatggtgatggacagagttatcgaggctcattctccaccactgttacaggaaggacatgtcagtcttggtcctctatgacmccacactggcatcagagaaccacagaatactacccaaatggtggcctgaccaggaactactgcaggaatccagatgctgagattcgcccttggtgttata

SEQ ID NO: 4269 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcagcaccaactgagcaaacccctgtggtccggcagtgctaccatggtaatggccagagttatcgaggcacattctccaccact

SEQ ID NO: 4270 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaagcaccaactgaaaacagcactggggtccaggactgctaccgaggtgatggacagagttatcgaggcacactctccaccactatcac

SEQ ID NO: 4271 - DNA, 201 bp, Homo sapiens
ctgctgctcactgcttgaagaagtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggcctgccgtcatcactgacaaagtaatgccagcttgtc

SEQ ID NO: 4272 - DNA, 201 bp, Homo sapiens
ttcacaaacccttgcaacattgcctgaagtttatggaataagatgtattctcactcccttgatctcaagggcgtaactctggaagcacagcttgactacaygtcatttttaccaatgattttcaggtgacctgggctaagtcatttaaactgggtctttataaaagtaaaaggccaacatttaattattttgcaaagcaac

SEQ ID NO: 4273 - DNA, 201 bp, Homo sapiens
gcctctgccaggttcggtccgccatcctcgtcccgtcctccgccggcccctgccccgcgcccagggatcctccagctcctttcgcccgcgccctccgttcrctccggacaccatggacaagttttggtggcacgcagcctggggactctgcctcgtgccgctgagcctggcgcagatcgatttgaatataacctgccgctt

SEQ ID NO: 4274 - DNA, 201 bp, Homo sapiens
gttggaaacataaccattacagggagctgggacacttaacagatgcaatgtgctactgattgtttcattgcgaatcttttttagcataaaattttctactytttttgttttttgtgttttgttctttaaagtcaggtccaatttgtaaaaacagcattgctttctgaaattagggcccaattaataatcagcaagaatttg

SEQ ID NO: 4275 - DNA, 201 bp, Homo sapiens
acctgcaggtatgggttcatagaagggcacgtggtgattccccggatccaccccaactccatctgtgcagcaaacaacacaggggtgtacatcctcacatmcaacacctcccagtatgacacatattgcttcaatgcttcagctccacctgaagaagattgtacatcagtcacagacctgcccaatgcctttgatggacca

SEQ ID NO: 4276 - DNA, 201 bp, Homo sapiens
tgcctcgtgccgctgagcctggcgcagatcgatttgaatataacctgccgctttgcaggtgtattccacgtggagaaaaatggtcgctacagcatctctcsgacggaggccgctgacctctgcaaggctttcaatagcaccttgcccacaatggcccagatggagaaagctctgagcatcggatttgagacctgcaggtat

SEQ ID NO: 4277 - DNA, 201 bp, Homo sapiens
tattttggaattaaatacttttttccctttattactgttgtagtccctcacttggatatacctctgttttcacgatagaaataagggaggtctagagcttytattccttggccattgtcaacggagagctggccaagtcttcacaaacccttgcaacattgcctgaagtttatggaataagatgtattctcactcccttga

SEQ ID NO: 4278 - DNA, 201 bp, Homo sapiens
aaacataaccattacagggagctgggacacttaacagatgcaatgtgctactgattgtttcattgcgaatcttttttagcataaaattttctactcttttygttttttgtgttttgttctttaaagtcaggtccaatttgtaaaaacagcattgctttctgaaattagggcccaattaataatcagcaagaatttgatcgt

SEQ ID NO: 4279 - DNA, 201 bp, Homo sapiens
aatgaagatgaaagagacagacacctcagtttttctggatcaggcattgatgatgatgaagattttatctccagcaccaatatggactccagtcatagtayaacgcttcagcctactgcaaatccaaacacaggtttggtggaagatttggacaggacaggacctctttcaatgacaacgcagcagagtaattctcagagc

SEQ ID NO: 4280 - DNA, 201 bp, Homo sapiens
aacttatgtgcttaacaggcaatgcttctcagaccacaaagcagaaagaagaagaaaagctcctgactaaatcagggctgggcttagacagagttgatctrtagaatatctttaaaggagagatgtcaactttctgcactattcccagcctctgctcctccctgtctaccctctcccctccctctctccctccacttcacc

SEQ ID NO: 4281 - DNA, 201 bp, Homo sapiens
ccacgtccctggcagccccgattatttacagcctcagcagagcacggggcgggggcagaggggcccgcccgggagggctgctacttcttaaaacctctgckggctgcttagtcacagccccccttgcttgggtgtgtccttcgctcgctccctccctccgtcttaggtcactgttttcaacctcgaataaaaactgcagcc

SEQ ID NO: 4282 - DNA, 201 bp, Homo sapiens
tctgcaaggctttcaatagcaccttgcccacaatggcccagatggagaaagctctgagcatcggatttgagacctgcaggtatgggttcatagaagggcaygtggtgattccccggatccaccccaactccatctgtgcagcaaacaacacaggggtgtacatcctcacatccaacacctcccagtatgacacatattgct

SEQ ID NO: 4283 - DNA, 201 bp, Homo sapiens
accagctaaggacatttcccagggttaatagggcctggtccctgggaggaaatttgaatgggtccattttgcccttccatagcctaatccctgggcattgytttccactgaggttgggggttggggtgtactagttacacatcttcaacagaccccctctagaaatttttcagatgcttctgggagacacccaaagggtga

SEQ ID NO: 4284 - DNA, 201 bp, Homo sapiens
ccctgggaggaaatttgaatgggtccattttgcccttccatagcctaatccctgggcattgctttccactgaggttgggggttggggtgtactagttacayatcttcaacagaccccctctagaaatttttcagatgcttctgggagacacccaaagggtgaagctatttatctgtagtaaactatttatctgtgtttttg

SEQ ID NO: 4285 - DNA, 201 bp, Homo sapiens
cattgatgatgatgaagattttatctccagcaccaatatggactccagtcatagtataacgcttcagcctactgcaaatccaaacacaggtttggtggaasatttggacaggacaggacctctttcaatgacaacgcagcagagtaattctcagagcttctctacatcacatgaaggcttggaagaagataaagaccatcc

SEQ ID NO: 4286 - DNA, 201 bp, Homo sapiens; identical to SEQ ID NO: 4272

SEQ ID NO: 4287 - DNA, 201 bp, Homo sapiens; identical to SEQ ID NO: 4273

SEQ ID NO: 4288 - DNA, 201 bp, Homo sapiens; identical to SEQ ID NO: 4274

SEQ ID NO: 4289 - DNA, 201 bp, Homo sapiens; identical to SEQ ID NO: 4275

SEQ ID NO: 4290 - DNA, 201 bp, Homo sapiens; identical to SEQ ID NO: 4276

SEQ ID NO: 4291 - DNA, 201 bp, Homo sapiens; identical to SEQ ID NO: 4277

SEQ ID NO: 4292 - DNA, 201 bp, Homo sapiens; identical to SEQ ID NO: 4278

SEQ ID NO: 4293 - DNA, 201 bp, Homo sapiens
accttttctactgtacaccccatcccagacgaagacagtccctggatcaccgacagcacagacagaatccctgctaccaatatggactccagtcatagtayaacgcttcagcctactgcaaatccaaacacaggtttggtggaagatttggacaggacaggacctctttcaatgacaacgcagcagagtaattctcagagc

SEQ ID NO: 4294 - DNA, 201 bp, Homo sapiens; identical to SEQ ID NO: 4280

SEQ ID NO: 4295 - DNA, 201 bp, Homo sapiens; identical to SEQ ID NO: 4281

SEQ ID NO: 4296 - DNA, 201 bp, Homo sapiens; identical to SEQ ID NO: 4282

SEQ ID NO: 4297 - DNA, 201 bp, Homo sapiens
tggcttctaagacatttcccagggttaatagggcctggtccctgggaggaaatttgaatgggtccattttgcccttccatagcctaatccctgggcattgytttccactgaggttgggggttggggtgtactagttacacatcttcaacagaccccctctagaaatttttcagatgcttctgggagacacccaaagggtga

SEQ ID NO: 4298 - DNA, 201 bp, Homo sapiens; identical to SEQ ID NO: 4284

SEQ ID NO: 4299 - DNA, 201 bp, Homo sapiens
gatcaccgacagcacagacagaatccctgctaccaatatggactccagtcatagtataacgcttcagcctactgcaaatccaaacacaggtttggtggaasatttggacaggacaggacctctttcaatgacaacgcagcagagtaattctcagagcttctctacatcacatgaaggcttggaagaagataaagaccatcc

SEQ ID NO: 4300 - DNA, 201 bp, Homo sapiens; identical to SEQ ID NO: 4275

SEQ ID NO: 4301 - DNA, 201 bp, Homo sapiens; identical to SEQ ID NO: 4276

SEQ ID NO: 4302 - DNA, 201 bp, Homo sapiens; identical to SEQ ID NO: 4272

SEQ ID NO: 4303 - DNA, 201 bp, Homo sapiens; identical to SEQ ID NO: 4277

SEQ ID NO: 4304 - DNA, 201 bp, Homo sapiens; identical to SEQ ID NO: 4280

SEQ ID NO: 4305 - DNA, 201 bp, Homo sapiens; identical to SEQ ID NO: 4284

SEQ ID NO: 4306 - DNA, 201 bp, Homo sapiens; identical to SEQ ID NO: 4283

SEQ ID NO: 4307 - DNA, 201 bp, Homo sapiens; identical to SEQ ID NO: 4281

SEQ ID NO: 4308 - DNA, 201 bp, Homo sapiens; identical to SEQ ID NO: 4282

SEQ ID NO: 4309 - DNA, 201 bp, Homo sapiens; identical to SEQ ID NO: 4273

SEQ ID NO: 4310 - DNA, 201 bp, Homo sapiens
gttggaaacataaccattacagggagctgggacacttaacagatgcaatgtgctactgattgtttcattgcgaatcttttttagcataaaattttctactytttcccccaccagctaaggacatttcccagggttaatagggcctggtccctgggaggaaatttgaatgggtccattttgcccttccatagcctaatccct

SEQ ID NO: 4311 - DNA, 201 bp, Homo sapiens
tgcctcgtgccgctgagcctggcgcagatcgatttgaatataacctgccgctttgcaggtgtattccacgtggagaaaaatggtcgctacagcatctctcsgacggaggccgctgacctctgcaaggctttcaatagcaccttgcccacaatggcccagatggagaaagctctgagcatcggatttgagacctgcagtttg

SEQ ID NO: 4312 - DNA, 201 bp, Homo sapiens; identical to SEQ ID NO: 4272

SEQ ID NO: 4313 - DNA, 201 bp, Homo sapiens; identical to SEQ ID NO: 4278

SEQ ID NO: 4314 - DNA, 201 bp, Homo sapiens; identical to SEQ ID NO: 4277

SEQ ID NO: 4315 - DNA, 201 bp, Homo sapiens; identical to SEQ ID NO: 4280

SEQ ID NO: 4316 - DNA, 201 bp, Homo sapiens; identical to SEQ ID NO: 4281

SEQ ID NO: 4317 - DNA, 201 bp, Homo sapiens; identical to SEQ ID NO: 4273

SEQ ID NO: 4318 - DNA, 201 bp, Homo sapiens; identical to SEQ ID NO: 4297

SEQ ID NO: 4319 - DNA, 201 bp, Homo sapiens; identical to SEQ ID NO: 4274

SEQ ID NO: 4320 - DNA, 201 bp, Homo sapiens; identical to SEQ ID NO: 4284

SEQ ID NO: 4321 - DNA, 201 bp, Homo sapiens; identical to SEQ ID NO: 4272

SEQ ID NO: 4322 - DNA, 201 bp, Homo sapiens; identical to SEQ ID NO: 4273

SEQ ID NO: 4323 - DNA, 201 bp, Homo sapiens; identical to SEQ ID NO: 4274

SEQ ID NO: 4324 - DNA, 201 bp, Homo sapiens; identical to SEQ ID NO: 4275

SEQ ID NO: 4325 - DNA, 201 bp, Homo sapiens; identical to SEQ ID NO: 4276

SEQ ID NO: 4326 - DNA, 201 bp, Homo sapiens; identical to SEQ ID NO: 4277

SEQ ID NO: 4327 - DNA, 201 bp, Homo sapiens; identical to SEQ ID NO: 4278

SEQ ID NO: 4328 - DNA, 201 bp, Homo sapiens
accttttctactgtacaccccatcccagacgaagacagtccctggatcaccgacagcacagacagaatccctgctaccaatatggactccagtcatagtayaacgcttcagcctactgcaaatccaaacacaggtttggtggaagatttggacaggacaggacctctttcaatgacaacgcgagaccaagacacattccac

SEQ ID NO: 4329 - DNA, 201 bp, Homo sapiens; identical to SEQ ID NO: 4280

SEQ ID NO: 4330 - DNA, 201 bp, Homo sapiens; identical to SEQ ID NO: 4281

SEQ ID NO: 4331 - DNA, 201 bp, Homo sapiens; identical to SEQ ID NO: 4282

SEQ ID NO: 4332 - DNA, 201 bp, Homo sapiens; identical to SEQ ID NO: 4283

SEQ ID NO: 4333 - DNA, 201 bp, Homo sapiens; identical to SEQ ID NO: 4284

SEQ ID NO: 4334 - DNA, 201 bp, Homo sapiens
gatcaccgacagcacagacagaatccctgctaccaatatggactccagtcatagtataacgcttcagcctactgcaaatccaaacacaggtttggtggaasatttggacaggacaggacctctttcaatgacaacgcgagaccaagacacattccaccccagtggggggtcccataccactcatggatctgaatcagatgg

SEQ ID NO: 4335 - DNA, 201 bp, Homo sapiens
aacccagaagcacaccctcccctcattcaccatgagcatcatgaggaagaagagaccccacattctacaagcacaatccaggcaactcctagtagtacaayggaagaaacagctacccagaaggaacagtggtttggcaacagatggcatgagggatatcgccaaacacccagagaagactcccattcgacaacagggaca

SEQ ID NO: 4336 - DNA, 201 bp, Homo sapiens
aaggaacagtggtttggcaacagatggcatgagggatatcgccaaacacccagagaagactcccattcgacaacagggacagctgcagcctcagctcatamcagccatccaatgcaaggaaggacaacaccaagcccagaggacagttcctggactgatttcttcaacccaatctcacaccccatgggacgaggtcatcaa

SEQ ID NO: 4337 - DNA, 201 bp, Homo sapiens; identical to SEQ ID NO: 4277

SEQ ID NO: 4338 - DNA, 201 bp, Homo sapiens
caagcacaatccaggcaactcctagtagtacaacggaagaaacagctacccagaaggaacagtggtttggcaacagatggcatgagggatatcgccaaacmcccagagaagactcccattcgacaacagggacagctgcagcctcagctcataccagccatccaatgcaaggaaggacaacaccaagcccagaggacagtt

SEQ ID NO: 4339 - DNA, 201 bp, Homo sapiens
tcaccgacagcacagacagaatccctgctaccactttgatgagcactagtgctacagcaactgagacagcaaccaagaggcaagaaacctgggattggttytcatggttgtttctaccatcagagtcaaagaatcatcttcacacaacaacacaaatggctggtacgtcttcaaataccatctcagcaggctgggagccaa

SEQ ID NO: 4340 - DNA, 201 bp, Homo sapiens
gaggacagttcctggactgatttcttcaacccaatctcacaccccatgggacgaggtcatcaagcaggaagaaggatggatatggactccagtcatagtayaacgcttcagcctactgcaaatccaaacacaggtttggtggaagatttggacaggacaggacctctttcaatgacaacgcagcagagtaattctcagagc

SEQ ID NO: 4341 - DNA, 201 bp, Homo sapiens; identical to SEQ ID NO: 4284

SEQ ID NO: 4342 - DNA, 201 bp, Homo sapiens; identical to SEQ ID NO: 4281

SEQ ID NO: 4343 - DNA, 201 bp, Homo sapiens; identical to SEQ ID NO: 4282

SEQ ID NO: 4344 - DNA, 201 bp, Homo sapiens
ccacaaggatgactgatgtagacagaaatggcaccactgcttatgaaggaaactggaacccagaagcacaccctcccctcattcaccatgagcatcatgargaagaagagaccccacattctacaagcacaatccaggcaactcctagtagtacaacggaagaaacagctacccagaaggaacagtggtttggcaacagat

SEQ ID NO: 4345 - DNA, 201 bp, Homo sapiens
acaatccaggcaactcctagtagtacaacggaagaaacagctacccagaaggaacagtggtttggcaacagatggcatgagggatatcgccaaacacccaragaagactcccattcgacaacagggacagctgcagcctcagctcataccagccatccaatgcaaggaaggacaacaccaagcccagaggacagttcctgg

SEQ ID NO: 4346 - DNA, 201 bp, Homo sapiens
catgggacgaggtcatcaagcaggaagaaggatggatatggactccagtcatagtataacgcttcagcctactgcaaatccaaacacaggtttggtggaasatttggacaggacaggacctctttcaatgacaacgcagcagagtaattctcagagcttctctacatcacatgaaggcttggaagaagataaagaccatcc

SEQ ID NO: 4347 - DNA, 201 bp, Homo sapiens; identical to SEQ ID NO: 4272

SEQ ID NO: 4348 - DNA, 201 bp, Homo sapiens
tttctggatcaggcattgatgatgatgaagattttatctccagcaccatttcaaccacaccacgggcttttgaccacacaaaacagaaccaggactggacycagtggaacccaagccattcaaatccggaagtgctacttcagacaaccacaaggatgactgatgtagacagaaatggcaccactgcttatgaaggaaact

SEQ ID NO: 4349 - DNA, 201 bp, Homo sapiens; identical to SEQ ID NO: 4274

SEQ ID NO: 4350 - DNA, 201 bp, Homo sapiens; identical to SEQ ID NO: 4273

SEQ ID NO: 4351 - DNA, 201 bp, Homo sapiens; identical to SEQ ID NO: 4275

SEQ ID NO: 4352 - DNA, 201 bp, Homo sapiens; identical to SEQ ID NO: 4276

SEQ ID NO: 4353 - DNA, 201 bp, Homo sapiens; identical to SEQ ID NO: 4278

SEQ ID NO: 4354 - DNA, 201 bp, Homo sapiens; identical to SEQ ID NO: 4280

SEQ ID NO: 4355 - DNA, 201 bp, Homo sapiens; identical to SEQ ID NO: 4283

SEQ ID NO: 4356 - DNA, 201 bp, Homo sapiens; identical to SEQ ID NO: 4272

SEQ ID NO: 4357 - DNA, 201 bp, Homo sapiens; identical to SEQ ID NO: 4273

SEQ ID NO: 4358 - DNA, 201 bp, Homo sapiens; identical to SEQ ID NO: 4274

SEQ ID NO: 4359 - DNA, 201 bp, Homo sapiens; identical to SEQ ID NO: 4275

SEQ ID NO: 4360 - DNA, 201 bp, Homo sapiens; identical to SEQ ID NO: 4276

SEQ ID NO: 4361 - DNA, 201 bp, Homo sapiens; identical to SEQ ID NO: 4277

SEQ ID NO: 4362 - DNA, 201 bp, Homo sapiens; identical to SEQ ID NO: 4278

SEQ ID NO: 4363 - DNA, 201 bp, Homo sapiens; identical to SEQ ID NO: 4293

SEQ ID NO: 4364 - DNA, 201 bp, Homo sapiens; identical to SEQ ID NO: 4280

SEQ ID NO: 4365 - DNA, 201 bp, Homo sapiens; identical to SEQ ID NO: 4281

SEQ ID NO: 4366 - DNA, 201 bp, Homo sapiens; identical to SEQ ID NO: 4282

SEQ ID NO: 4367 - DNA, 201 bp, Homo sapiens; identical to SEQ ID NO: 4283

SEQ ID NO: 4368 - DNA, 201 bp, Homo sapiens; identical to SEQ ID NO: 4284

SEQ ID NO: 4369 - DNA, 201 bp, Homo sapiens; identical to SEQ ID NO: 4299

SEQ ID NO: 4370 - DNA, 201 bp, Homo sapiens
ggaaactggaacccagaagcacaccctcccctcattcaccatgagcatcatgaggaagaagagaccccacattctacaagcacaacagcctcagctcatamcagccatccaatgcaaggaaggacaacaccaagcccagaggacagttcctggactgatttcttcaacccaatctcacaccccatgggacgaggtcatcaa

SEQ ID NO: 4371 - DNA, 201 bp, Homo sapiens; identical to SEQ ID NO: 4340

SEQ ID NO: 4372 - DNA, 201 bp, Homo sapiens
tcaccgacagcacagacagaatccctgctaccactttgatgagcactagtgctacagcaactgagacagcaaccaagaggcaagaaacctgggattggttytcatggttgtttctaccatcagagtcaaagaatcatcttcacacaacaacacaaatggctgcaggctgggagccaaatgaagaaaatgaagatgaaagag

SEQ ID NO: 4373 - DNA, 201 bp, Homo sapiens; identical to SEQ ID NO: 4277

SEQ ID NO: 4374 - DNA, 201 bp, Homo sapiens
ccacaaggatgactgatgtagacagaaatggcaccactgcttatgaaggaaactggaacccagaagcacaccctcccctcattcaccatgagcatcatgargaagaagagaccccacattctacaagcacaacagcctcagctcataccagccatccaatgcaaggaaggacaacaccaagcccagaggacagttcctgga

SEQ ID NO: 4375 - DNA, 201 bp, Homo sapiens; identical to SEQ ID NO: 4282

SEQ ID NO: 4376 - DNA, 201 bp, Homo sapiens; identical to SEQ ID NO: 4281

SEQ ID NO: 4377 - DNA, 201 bp, Homo sapiens; identical to SEQ ID NO: 4284

SEQ ID NO: 4378 - DNA, 201 bp, Homo sapiens; identical to SEQ ID NO: 4346

SEQ ID NO: 4379 - DNA, 201 bp, Homo sapiens; identical to SEQ ID NO: 4272

SEQ ID NO: 4380 - DNA, 201 bp, Homo sapiens; identical to SEQ ID NO: 4348

SEQ ID NO: 4381 - DNA, 201 bp, Homo sapiens; identical to SEQ ID NO: 4274

SEQ ID NO: 4382 - DNA, 201 bp, Homo sapiens; identical to SEQ ID NO: 4273

SEQ ID NO: 4383 - DNA, 201 bp, Homo sapiens; identical to SEQ ID NO: 4275

SEQ ID NO: 4384 - DNA, 201 bp, Homo sapiens; identical to SEQ ID NO: 4276

SEQ ID NO: 4385 - DNA, 201 bp, Homo sapiens; identical to SEQ ID NO: 4278

SEQ ID NO: 4386 - DNA, 201 bp, Homo sapiens; identical to SEQ ID NO: 4280

SEQ ID NO: 4387 - DNA, 201 bp, Homo sapiens; identical to SEQ ID NO: 4297

SEQ ID NO: 4388 - DNA, 201 bp, Homo sapiens; identical to SEQ ID NO: 4335

SEQ ID NO: 4389 - DNA, 201 bp, Homo sapiens; identical to SEQ ID NO: 4336

SEQ ID NO: 4390 - DNA, 201 bp, Homo sapiens; identical to SEQ ID NO: 4277

SEQ ID NO: 4391 - DNA, 201 bp, Homo sapiens; identical to SEQ ID NO: 4338

SEQ ID NO: 4392 - DNA, 201 bp, Homo sapiens; identical to SEQ ID NO: 4339

SEQ ID NO: 4393 - DNA, 201 bp, Homo sapiens; identical to SEQ ID NO: 4340

SEQ ID NO: 4394 - DNA, 201 bp, Homo sapiens; identical to SEQ ID NO: 4284

SEQ ID NO: 4395 - DNA, 201 bp, Homo sapiens; identical to SEQ ID NO: 4281

SEQ ID NO: 4396 - DNA, 201 bp, Homo sapiens; identical to SEQ ID NO: 4282

SEQ ID NO: 4397 - DNA, 201 bp, Homo sapiens; identical to SEQ ID NO: 4344

SEQ ID NO: 4398 - DNA, 201 bp, Homo sapiens; identical to SEQ ID NO: 4345

SEQ ID NO: 4399 - DNA, 201 bp, Homo sapiens; identical to SEQ ID NO: 4346

SEQ ID NO: 4400 - DNA, 201 bp, Homo sapiens; identical to SEQ ID NO: 4272

SEQ ID NO: 4401 - DNA, 201 bp, Homo sapiens; identical to SEQ ID NO: 4348

SEQ ID NO: 4402 - DNA, 201 bp, Homo sapiens; identical to SEQ ID NO: 4274

SEQ ID NO: 4403 - DNA, 201 bp, Homo sapiens; identical to SEQ ID NO: 4273

SEQ ID NO: 4404 - DNA, 201 bp, Homo sapiens; identical to SEQ ID NO: 4275

SEQ ID NO: 4405 - DNA, 201 bp, Homo sapiens; identical to SEQ ID NO: 4276

SEQ ID NO: 4406 - DNA, 201 bp, Homo sapiens; identical to SEQ ID NO: 4278

SEQ ID NO: 4407 - DNA, 201 bp, Homo sapiens; identical to SEQ ID NO: 4280

SEQ ID NO: 4408 - DNA, 201 bp, Homo sapiens; identical to SEQ ID NO: 4283

SEQ ID NO: 4409 - DNA, 201 bp, Homo sapiens; identical to SEQ ID NO: 4370

SEQ ID NO: 4410 - DNA, 201 bp, Homo sapiens; identical to SEQ ID NO: 4340

SEQ ID NO: 4411 - DNA, 201 bp, Homo sapiens
gctcctccagtgaaaggagcagcacttcaggagctttgatgagcactagtgctacagcaactgagacagcaaccaagaggcaagaaacctgggattggttytcatggttgtttctaccatcagagtcaaagaatcatcttcacacaacaacacaaatggctggtacgtcttcaaataccatctcagcaggctgggagccaa

SEQ ID NO: 4412 - DNA, 201 bp, Homo sapiens; identical to SEQ ID NO: 4277

SEQ ID NO: 4413 - DNA, 201 bp, Homo sapiens; identical to SEQ ID NO: 4374

SEQ ID NO: 4414 - DNA, 201 bp, Homo sapiens; identical to SEQ ID NO: 4282

SEQ ID NO: 4415 - DNA, 201 bp, Homo sapiens; identical to SEQ ID NO: 4281

SEQ ID NO: 4416 - DNA, 201 bp, Homo sapiens; identical to SEQ ID NO: 4284

SEQ ID NO: 4417 - DNA, 201 bp, Homo sapiens; identical to SEQ ID NO: 4346

SEQ ID NO: 4418 - DNA, 201 bp, Homo sapiens; identical to SEQ ID NO: 4272

SEQ ID NO: 4419 - DNA, 201 bp, Homo sapiens; identical to SEQ ID NO: 4348

SEQ ID NO: 4420 - DNA, 201 bp, Homo sapiens; identical to SEQ ID NO: 4274

SEQ ID NO: 4421 - DNA, 201 bp, Homo sapiens; identical to SEQ ID NO: 4273

SEQ ID NO: 4422 - DNA, 201 bp, Homo sapiens; identical to SEQ ID NO: 4275

SEQ ID NO: 4423 - DNA, 201 bp, Homo sapiens; identical to SEQ ID NO: 4276

SEQ ID NO: 4424 - DNA, 201 bp, Homo sapiens; identical to SEQ ID NO: 4278

SEQ ID NO: 4425 - DNA, 201 bp, Homo sapiens; identical to SEQ ID NO: 4280

SEQ ID NO: 4426 - DNA, 201 bp, Homo sapiens; identical to SEQ ID NO: 4283

SEQ ID NO: 4427 - DNA, 201 bp, Homo sapiens
aagctgccaaaccactgccagcagctgcctaaccactgccagcagctgcctatctccagacatcttggttggtctaattgaaggcaatggagaagtaagtktttatggatcaaaatcttagctctagaaaaggcctaaggcaatagctaattgagactatgcatcactattaaggcatcttcactaaagggcgctgtggaa

SEQ ID NO: 4428 - DNA, 201 bp, Homo sapiens
tgccaaaccactgccagcagctgcctaaccactgccagcagctgcctatctccagacatcttggttggtctaattgaaggcaatggagaagtaagtctttmtggatcaaaatcttagctctagaaaaggcctaaggcaatagctaattgagactatgcatcactattaaggcatcttcactaaagggcgctgtggaaacgc

SEQ ID NO: 4429 - DNA, 201 bp, Homo sapiens
caatcctcccatctcaatgtccggagtagctgggactacagatgtgtgttagcggctatggcagccatcttgtgaccaggaggaagcttctgagaatcacrgagatgcaacctctgaagctgccaaaccactgccagcagctgcctaaccactgccagcagctgcctatctccagacatcttggttggtctaattgaaggc

SEQ ID NO: 4430 - DNA, 201 bp, Homo sapiens
gagaggaaagtcccttattgattggccaacaatcaacagtttctgatgttccgagggacctggaagttgttgctgcgacccccaccagcctactgatcagmtgggatgctcctgctgtcacagtgagatattacaggatcacttacggagaaacaggaggaaatagccctgtccaggagttcactgtgcctgggagcaagt

SEQ ID NO: 4431 - DNA, 201 bp, Homo sapiens
cacctcgggcccagataacaggataccgactgaccgtgggccttacccgaagaggacagcccaggcagtacaatgtgggtccctctgtctccaagtacccmctgaggaatctgcagcctgcatctgagtacaccgtatccctcgtggccataaagggcaaccaagagagccccaaagccactggagtctttaccacactgc

SEQ ID NO: 4432 - DNA, 201 bp, Homo sapiens
tcatcctgttggcactgatgaagaacccttacagttcagggttcctggaacttctaccagtgccactctgacaggcctcaccagaggtgccacctacaacrtcatagtggaggcactgaaagaccagcagaggcataaggttcgggaagaggttgttaccgtgggcaactctgtcaacgaaggcttgaaccaacctacgga

SEQ ID NO: 4433 - DNA, 201 bp, Homo sapiens
cgaatatacaatttatgtcattgccctgaagaataatcagaagagcgagcccctgattggaaggaaaaagacaggacaagaagctctctctcagacaaccrtctcatgggccccattccaggacacttctgagtacatcatttcatgtcatcctgttggcactgatgaagaacccttacagttcagggttcctggaacttc

SEQ ID NO: 4434 - DNA, 201 bp, Homo sapiens
agtttgtcaatgaaactgattctactgtcctggtgagatggactccacctcgggcccagataacaggataccgactgaccgtgggccttacccgaagaggmcagcccaggcagtacaatgtgggtccctctgtctccaagtacccactgaggaatctgcagcctgcatctgagtacaccgtatccctcgtggccataaagg

SEQ ID NO: 4435 - DNA, 201 bp, Homo sapiens
aaagggcaaccaagagagccccaaagccactggagtctttaccacactgcagcctgggagctctattccaccttacaacaccgaggtgactgagaccaccmttgtgatcacatggacgcctgctccaagaattggttttaagctgggtgtacgaccaagccagggaggagaggcaccacgagaagtgacttcagactcagg

SEQ ID NO: 4436 - DNA, 201 bp, Homo sapiens
acagctcatccgtggttgtatcaggacttatggtggccaccaaatatgaagtgagtgtctatgctcttaaggacactttgacaagcagaccagctcagggwgttgtcaccactctggagaatgtcagcccaccaagaagggctcgtgtgacagatgctactgagaccaccatcaccattagctggagaaccaagactgaga

SEQ ID NO: 4437 - DNA, 201 bp, Homo sapiens
ggggatgcagtggctgaagacacaaggaaataagcaaatgctttgcacgtgcctgggcaacggagtcagctgccaagagacagctgtaacccagacttacrgtggcaactcaaatggagagccatgtgtcttaccattcacctacaatggcaggacgttctactcctgcaccacagaagggcgacaggacggacatctttg

SEQ ID NO: 4438 - DNA, 201 bp, Homo sapiens
cgagggacctggaagttgttgctgcgacccccaccagcctactgatcagctgggatgctcctgctgtcacagtgagatattacaggatcacttacggagaracaggaggaaatagccctgtccaggagttcactgtgcctgggagcaagtctacagctaccatcagcggccttaaacctggagttgattataccatcactg

SEQ ID NO: 4439 - DNA, 201 bp, Homo sapiens
acagtactcactttttccaaatgatcctagtaattgcctagaaatatctttctcttacctgttatttatcaatttttcccagtatttttatacggaaaaarttgtattgaaaacacttagtatgcagttgataagaggaatttggtataattatggtgggtgattattttttatactgtatgtgccaaagctttactactg

SEQ ID NO: 4440 - DNA, 201 bp, Homo sapiens
ccgaaaatacattgtaaatgtctatcagatatctgaggatggggagcagagtttgatcctgtctacttcacaaacaacagcgcctgatgccccacctgacmcgactgtggaccaagttgatgacacctcaattgttgttcgctggagcagaccccaggctcccatcacaggtcagctaaaatagtctattcgccatcagta

SEQ ID NO: 4441 - DNA, 201 bp, Homo sapiens
gcaaacttggtggcaacttgcctcccggtgcgggcgtctctcccccaccgtctcaacatgcttaggggtccggggcccgggctgctgctgctggccgtccwgtgcctggggacagcggtgccctccacgggagcctcgaagagcaagaggcaggctcagcaaatggttcagccccagtccccggtggctgtcagtcaaagc

SEQ ID NO: 4442 - DNA, 201 bp, Homo sapiens
ttcctggccgaaaatacattgtaaatgtctatcagatatctgaggatggggagcagagtttgatcctgtctacttcacaaacaacagcgcctgatgccccwcctgacccgactgtggaccaagttgatgacacctcaattgttgttcgctggagcagaccccaggctcccatcacaggtcagctaaaatagtctattcgcc

SEQ ID NO: 4443 - DNA, 201 bp, Homo sapiens
gccctaaaggactggcattcactgatgtggatgtcgattccatcaaaattgcttgggaaagcccacaggggcaagtttccaggtacagggtgacctactckagccctgaggatggaatccatgagctattccctgcacctgatggtgaagaagacactgcagagctgcaaggcctcagaccgggttctgagtacacagtca

SEQ ID NO: 4444 - DNA, 201 bp, Homo sapiens
agtgggaccgtcagggagaaaatggccagatgatgagctgcacatgtcttgggaacggaaaaggagaattcaagtgtgaccctcatgaggcaacgtgttaygatgatgggaagacataccacgtaggagaacagtggcagaaggaatatctcggtgccatttgctcctgcacatgctttggaggccagcggggctggcgct

SEQ ID NO: 4445 - DNA, 201 bp, Homo sapiens
tgtctctctgccaagatccatctaaactggagtgatgttagcagacccagcttagagttcttctttctttcttaagccctttgctctggaggaagttctcyagcttcagctcaactcacagcttctccaagcatcaccctgggagtttcctgagggttttctcataaatgagggctgcacattgcctgttctgcttcgaag

SEQ ID NO: 4446 - DNA, 201 bp, Homo sapiens
ctgaagagacttgctttgacaagtacactgggaacacttaccgagtgggtgacacttatgagcgtcctaaagactccatgatctgggactgtacctgcatyggggctgggcgagggagaataagctgtaccatcgcaaaccgctgccatgaagggggtcagtcctacaagattggtgacacctggaggagaccacatgaga

SEQ ID NO: 4447 - DNA, 201 bp, Homo sapiens
ttctactgtcctggtgagatggactccacctcgggcccagataacaggataccgactgaccgtgggccttacccgaagaggacagcccaggcagtacaatrtgggtccctctgtctccaagtacccactgaggaatctgcagcctgcatctgagtacaccgtatccctcgtggccataaagggcaaccaagagagccccaa

SEQ ID NO: 4448 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctgtcaacgaaggcttgaaccaacctacggatgactcgtgctttgacccctacacagtttcccattatgccgtt

SEQ ID NO: 4449 - DNA, 201 bp, Homo sapiens; identical to SEQ ID NO: 4437

SEQ ID NO: 4450 - DNA, 201 bp, Homo sapiens; identical to SEQ ID NO: 4446

SEQ ID NO: 4451 - DNA, 201 bp, Homo sapiens; identical to SEQ ID NO: 4441

SEQ ID NO: 4452 - DNA, 201 bp, Homo sapiens; identical to SEQ ID NO: 4430

SEQ ID NO: 4453 - DNA, 201 bp, Homo sapiens; identical to SEQ ID NO: 4431

SEQ ID NO: 4454 - DNA, 201 bp, Homo sapiens; identical to SEQ ID NO: 4432

SEQ ID NO: 4455 - DNA, 201 bp, Homo sapiens
ttttaggcggaccacaccgcccacaacggccacccccataaggcataggccaagaccatacccgccgaatgtaggacaagaagctctctctcagacaaccrtctcatgggccccattccaggacacttctgagtacatcatttcatgtcatcctgttggcactgatgaagaacccttacagttcagggttcctggaacttc

SEQ ID NO: 4456 - DNA, 201 bp, Homo sapiens; identical to SEQ ID NO: 4434

SEQ ID NO: 4457 - DNA, 201 bp, Homo sapiens; identical to SEQ ID NO: 4435

SEQ ID NO: 4458 - DNA, 201 bp, Homo sapiens; identical to SEQ ID NO: 4436

SEQ ID NO: 4459 - DNA, 201 bp, Homo sapiens; identical to SEQ ID NO: 4437

SEQ ID NO: 4460 - DNA, 201 bp, Homo sapiens; identical to SEQ ID NO: 4438

SEQ ID NO: 4461 - DNA, 201 bp, Homo sapiens; identical to SEQ ID NO: 4439

SEQ ID NO: 4462 - DNA, 201 bp, Homo sapiens
ccgaaaatacattgtaaatgtctatcagatatctgaggatggggagcagagtttgatcctgtctacttcacaaacaacagcgcctgatgccccacctgacmcgactgtggaccaagttgatgacacctcaattgttgttcgctggagcagaccccaggctcccatcacagggtacagaatagtctattcgccatcagtaga

SEQ ID NO: 4463 - DNA, 201 bp, Homo sapiens; identical to SEQ ID NO: 4441

SEQ ID NO: 4464 - DNA, 201 bp, Homo sapiens
ttcctggccgaaaatacattgtaaatgtctatcagatatctgaggatggggagcagagtttgatcctgtctacttcacaaacaacagcgcctgatgccccwcctgacccgactgtggaccaagttgatgacacctcaattgttgttcgctggagcagaccccaggctcccatcacagggtacagaatagtctattcgccat

SEQ ID NO: 4465 - DNA, 201 bp, Homo sapiens; identical to SEQ ID NO: 4443

SEQ ID NO: 4466 - DNA, 201 bp, Homo sapiens; identical to SEQ ID NO: 4444

SEQ ID NO: 4467 - DNA, 201 bp, Homo sapiens; identical to SEQ ID NO: 4445

SEQ ID NO: 4468 - DNA, 201 bp, Homo sapiens; identical to SEQ ID NO: 4446

SEQ ID NO: 4469 - DNA, 201 bp, Homo sapiens; identical to SEQ ID NO: 4447

SEQ ID NO: 4470 - DNA, 201 bp, Homo sapiens; identical to SEQ ID NO: 4448

SEQ ID NO: 4471 - DNA, 201 bp, Homo sapiens; identical to SEQ ID NO: 4430

SEQ ID NO: 4472 - DNA, 201 bp, Homo sapiens; identical to SEQ ID NO: 4431

SEQ ID NO: 4473 - DNA, 201 bp, Homo sapiens; identical to SEQ ID NO: 4432

SEQ ID NO: 4474 - DNA, 201 bp, Homo sapiens; identical to SEQ ID NO: 4455

SEQ ID NO: 4475 - DNA, 201 bp, Homo sapiens; identical to SEQ ID NO: 4434

SEQ ID NO: 4476 - DNA, 201 bp, Homo sapiens; identical to SEQ ID NO: 4435

SEQ ID NO: 4477 - DNA, 201 bp, Homo sapiens; identical to SEQ ID NO: 4436

SEQ ID NO: 4478 - DNA, 201 bp, Homo sapiens; identical to SEQ ID NO: 4437

SEQ ID NO: 4479 - DNA, 201 bp, Homo sapiens; identical to SEQ ID NO: 4438

SEQ ID NO: 4480 - DNA, 201 bp, Homo sapiens; identical to SEQ ID NO: 4439

SEQ ID NO: 4481 - DNA, 201 bp, Homo sapiens; identical to SEQ ID NO: 4462

SEQ ID NO: 4482 - DNA, 201 bp, Homo sapiens; identical to SEQ ID NO: 4441

SEQ ID NO: 4483 - DNA, 201 bp, Homo sapiens; identical to SEQ ID NO: 4464

SEQ ID NO: 4484 - DNA, 201 bp, Homo sapiens; identical to SEQ ID NO: 4444

SEQ ID NO: 4485 - DNA, 201 bp, Homo sapiens; identical to SEQ ID NO: 4445

SEQ ID NO: 4486 - DNA, 201 bp, Homo sapiens; identical to SEQ ID NO: 4446

SEQ ID NO: 4487 - DNA, 201 bp, Homo sapiens; identical to SEQ ID NO: 4447

SEQ ID NO: 4488 - DNA, 201 bp, Homo sapiens; identical to SEQ ID NO: 4448

SEQ ID NO: 4489 - DNA, 201 bp, Homo sapiens; identical to SEQ ID NO: 4430

SEQ ID NO: 4490 - DNA, 201 bp, Homo sapiens; identical to SEQ ID NO: 4431

SEQ ID NO: 4491 - DNA, 201 bp, Homo sapiens; identical to SEQ ID NO: 4439

SEQ ID NO: 4492 - DNA, 201 bp, Homo sapiens; identical to SEQ ID NO: 4434

SEQ ID NO: 4493 - DNA, 201 bp, Homo sapiens; identical to SEQ ID NO: 4435

SEQ ID NO: 4494 - DNA, 201 bp, Homo sapiens; identical to SEQ ID NO: 4462

SEQ ID NO: 4495 - DNA, 201 bp, Homo sapiens; identical to SEQ ID NO: 4436

SEQ ID NO: 4496 - DNA, 201 bp, Homo sapiens; identical to SEQ ID NO: 4441

SEQ ID NO: 4497 - DNA, 201 bp, Homo sapiens; identical to SEQ ID NO: 4437

SEQ ID NO: 4498 - DNA, 201 bp, Homo sapiens; identical to SEQ ID NO: 4464

SEQ ID NO: 4499 - DNA, 201 bp, Homo sapiens; identical to SEQ ID NO: 4443

SEQ ID NO: 4500 - DNA, 201 bp, Homo sapiens; identical to SEQ ID NO: 4444

SEQ ID NO: 4501 - DNA, 201 bp, Homo sapiens; identical to SEQ ID NO: 4445

SEQ ID NO: 4502 - DNA, 201 bp, Homo sapiens; identical to SEQ ID NO: 4438

SEQ ID NO: 4503 - DNA, 201 bp, Homo sapiens; identical to SEQ ID NO: 4446

SEQ ID NO: 4504 - DNA, 201 bp, Homo sapiens; identical to SEQ ID NO: 4447

SEQ ID NO: 4505 - DNA, 201 bp, Homo sapiens; identical to SEQ ID NO: 4430

SEQ ID NO: 4506 - DNA, 201 bp, Homo sapiens; identical to SEQ ID NO: 4431

SEQ ID NO: 4507 - DNA, 201 bp, Homo sapiens; identical to SEQ ID NO: 4432

SEQ ID NO: 4508 - DNA, 201 bp, Homo sapiens
tcacatccccagggaagatgtagactatcacctgtacccacacggtccgggactcaatccaaatgcctctacaggacaagaagctctctctcagacaaccrtctcatgggccccattccaggacacttctgagtacatcatttcatgtcatcctgttggcactgatgaagaacccttacagttcagggttcctggaacttc

SEQ ID NO: 4509 - DNA, 201 bp, Homo sapiens; identical to SEQ ID NO: 4434

SEQ ID NO: 4510 - DNA, 201 bp, Homo sapiens; identical to SEQ ID NO: 4435

SEQ ID NO: 4511 - DNA, 201 bp, Homo sapiens; identical to SEQ ID NO: 4436

SEQ ID NO: 4512 - DNA, 201 bp, Homo sapiens; identical to SEQ ID NO: 4437

SEQ ID NO: 4513 - DNA, 201 bp, Homo sapiens
cataggccaagaccatacccgccgaatgtaggtgaggaaatccaaattggtcacatccccagggaagatgtagactatcacctgtacccacacggtccggkactcaatccaaatgcctctacaggacaagaagctctctctcagacaaccatctcatgggccccattccaggacacttctgagtacatcatttcatgtcat

SEQ ID NO: 4514 - DNA, 201 bp, Homo sapiens; identical to SEQ ID NO: 4438

SEQ ID NO: 4515 - DNA, 201 bp, Homo sapiens; identical to SEQ ID NO: 4439

SEQ ID NO: 4516 - DNA, 201 bp, Homo sapiens; identical to SEQ ID NO: 4462

SEQ ID NO: 4517 - DNA, 201 bp, Homo sapiens; identical to SEQ ID NO: 4441

SEQ ID NO: 4518 - DNA, 201 bp, Homo sapiens; identical to SEQ ID NO: 4443

SEQ ID NO: 4519 - DNA, 201 bp, Homo sapiens; identical to SEQ ID NO: 4464

SEQ ID NO: 4520 - DNA, 201 bp, Homo sapiens; identical to SEQ ID NO: 4444

SEQ ID NO: 4521 - DNA, 201 bp, Homo sapiens; identical to SEQ ID NO: 4445

SEQ ID NO: 4522 - DNA, 201 bp, Homo sapiens; identical to SEQ ID NO: 4446

SEQ ID NO: 4523 - DNA, 201 bp, Homo sapiens; identical to SEQ ID NO: 4447

SEQ ID NO: 4524 - DNA, 201 bp, Homo sapiens; identical to SEQ ID NO: 4448

SEQ ID NO: 4525 - DNA, 201 bp, Homo sapiens; identical to SEQ ID NO: 4430

SEQ ID NO: 4526 - DNA, 201 bp, Homo sapiens; identical to SEQ ID NO: 4431

SEQ ID NO: 4527 - DNA, 201 bp, Homo sapiens; identical to SEQ ID NO: 4432

SEQ ID NO: 4528 - DNA, 201 bp, Homo sapiens; identical to SEQ ID NO: 4455

SEQ ID NO: 4529 - DNA, 201 bp, Homo sapiens; identical to SEQ ID NO: 4434

SEQ ID NO: 4530 - DNA, 201 bp, Homo sapiens; identical to SEQ ID NO: 4435

SEQ ID NO: 4531 - DNA, 201 bp, Homo sapiens; identical to SEQ ID NO: 4436

SEQ ID NO: 4532 - DNA, 201 bp, Homo sapiens; identical to SEQ ID NO: 4437

SEQ ID NO: 4533 - DNA, 201 bp, Homo sapiens; identical to SEQ ID NO: 4438

SEQ ID NO: 4534 - DNA, 201 bp, Homo sapiens; identical to SEQ ID NO: 4439

SEQ ID NO: 4535 - DNA, 201 bp, Homo sapiens; identical to SEQ ID NO: 4462

SEQ ID NO: 4536 - DNA, 201 bp, Homo sapiens; identical to SEQ ID NO: 4441

SEQ ID NO: 4537 - DNA, 201 bp, Homo sapiens; identical to SEQ ID NO: 4464

SEQ ID NO: 4538 - DNA, 201 bp, Homo sapiens; identical to SEQ ID NO: 4443

SEQ ID NO: 4539 - DNA, 201 bp, Homo sapiens; identical to SEQ ID NO: 4444

SEQ ID NO: 4540 - DNA, 201 bp, Homo sapiens; identical to SEQ ID NO: 4445

SEQ ID NO: 4541 - DNA, 201 bp, Homo sapiens; identical to SEQ ID NO: 4446

SEQ ID NO: 4542 - DNA, 201 bp, Homo sapiens; identical to SEQ ID NO: 4447

SEQ ID NO: 4543 - DNA, 201 bp, Homo sapiens; identical to SEQ ID NO: 4448

SEQ ID NO: 4544 - DNA, 201 bp, Homo sapiens; identical to SEQ ID NO: 4430

SEQ ID NO: 4545 - DNA, 201 bp, Homo sapiens; identical to SEQ ID NO: 4431

SEQ ID NO: 4546 - DNA, 201 bp, Homo sapiens
tcatcctgttggcactgatgaagaacccttacagttcagggttcctggaacttctaccagtgccactctgacaggcctcaccagaggtgccacctacaacrtcatagtggaggcactgaaagaccagcagaggcataaggttcgggaagaggttgttaccgtgggcaactctggatggtgccatgacaatggtgtgaacta

SEQ ID NO: 4547 - DNA, 201 bp, Homo sapiens; identical to SEQ ID NO: 4433

SEQ ID NO: 4548 - DNA, 201 bp, Homo sapiens; identical to SEQ ID NO: 4434

SEQ ID NO: 4549 - DNA, 201 bp, Homo sapiens; identical to SEQ ID NO: 4435

SEQ ID NO: 4550 - DNA, 201 bp, Homo sapiens; identical to SEQ ID NO: 4436

SEQ ID NO: 4551 - DNA, 201 bp, Homo sapiens; identical to SEQ ID NO: 4437

SEQ ID NO: 4552 - DNA, 201 bp, Homo sapiens; identical to SEQ ID NO: 4438

SEQ ID NO: 4553 - DNA, 201 bp, Homo sapiens; identical to SEQ ID NO: 4439

SEQ ID NO: 4554 - DNA, 201 bp, Homo sapiens; identical to SEQ ID NO: 4440

SEQ ID NO: 4555 - DNA, 201 bp, Homo sapiens; identical to SEQ ID NO: 4441

SEQ ID NO: 4556 - DNA, 201 bp, Homo sapiens; identical to SEQ ID NO: 4442

SEQ ID NO: 4557 - DNA, 201 bp, Homo sapiens; identical to SEQ ID NO: 4443

SEQ ID NO: 4558 - DNA, 201 bp, Homo sapiens; identical to SEQ ID NO: 4444

SEQ ID NO: 4559 - DNA, 201 bp, Homo sapiens; identical to SEQ ID NO: 4445

SEQ ID NO: 4560 - DNA, 201 bp, Homo sapiens; identical to SEQ ID NO: 4446

SEQ ID NO: 4561 - DNA, 201 bp, Homo sapiens; identical to SEQ ID NO: 4447

SEQ ID NO: 4562 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctggatggtgccatgacaatggtgtgaactacaagattggagagaagtgggaccgtcagggagaaaatggccag

SEQ ID NO: 4563 - DNA, 201 bp, Homo sapiens; identical to SEQ ID NO: 4430

SEQ ID NO: 4564 - DNA, 201 bp, Homo sapiens; identical to SEQ ID NO: 4431

SEQ ID NO: 4565 - DNA, 201 bp, Homo sapiens; identical to SEQ ID NO: 4434

SEQ ID NO: 4566 - DNA, 201 bp, Homo sapiens; identical to SEQ ID NO: 4462

SEQ ID NO: 4567 - DNA, 201 bp, Homo sapiens; identical to SEQ ID NO: 4435

SEQ ID NO: 4568 - DNA, 201 bp, Homo sapiens; identical to SEQ ID NO: 4441

SEQ ID NO: 4569 - DNA, 201 bp, Homo sapiens; identical to SEQ ID NO: 4436

SEQ ID NO: 4570 - DNA, 201 bp, Homo sapiens
ctttgatactgtgtcatgagaatgcgaaactctgttcctgataacctcaaaaagcattctctgtgtaggagtggtagagcctaatacatcccaaaaggcaygagtgaaggaaaatgcaatttcaagactgtactaatggcatgactagactcatgttttcctttcgctgcaagtttgccagatacctgtcaattcagtcct

SEQ ID NO: 4571 - DNA, 201 bp, Homo sapiens; identical to SEQ ID NO: 4443

SEQ ID NO: 4572 - DNA, 201 bp, Homo sapiens; identical to SEQ ID NO: 4437

SEQ ID NO: 4573 - DNA, 201 bp, Homo sapiens; identical to SEQ ID NO: 4464

SEQ ID NO: 4574 - DNA, 201 bp, Homo sapiens; identical to SEQ ID NO: 4438

SEQ ID NO: 4575 - DNA, 201 bp, Homo sapiens; identical to SEQ ID NO: 4446

SEQ ID NO: 4576 - DNA, 201 bp, Homo sapiens; identical to SEQ ID NO: 4447

SEQ ID NO: 4577 - DNA, 201 bp, Homo sapiens; identical to SEQ ID NO: 4430

SEQ ID NO: 4578 - DNA, 201 bp, Homo sapiens; identical to SEQ ID NO: 4431

SEQ ID NO: 4579 - DNA, 201 bp, Homo sapiens; identical to SEQ ID NO: 4432

SEQ ID NO: 4580 - DNA, 201 bp, Homo sapiens; identical to SEQ ID NO: 4455

SEQ ID NO: 4581 - DNA, 201 bp, Homo sapiens; identical to SEQ ID NO: 4434

SEQ ID NO: 4582 - DNA, 201 bp, Homo sapiens; identical to SEQ ID NO: 4435

SEQ ID NO: 4583 - DNA, 201 bp, Homo sapiens; identical to SEQ ID NO: 4436

SEQ ID NO: 4584 - DNA, 201 bp, Homo sapiens; identical to SEQ ID NO: 4437

SEQ ID NO: 4585 - DNA, 201 bp, Homo sapiens; identical to SEQ ID NO: 4438

SEQ ID NO: 4586 - DNA, 201 bp, Homo sapiens; identical to SEQ ID NO: 4439

SEQ ID NO: 4587 - DNA, 201 bp, Homo sapiens; identical to SEQ ID NO: 4440

SEQ ID NO: 4588 - DNA, 201 bp, Homo sapiens; identical to SEQ ID NO: 4441

SEQ ID NO: 4589 - DNA, 201 bp, Homo sapiens; identical to SEQ ID NO: 4442

SEQ ID NO: 4590 - DNA, 201 bp, Homo sapiens; identical to SEQ ID NO: 4444

SEQ ID NO: 4591 - DNA, 201 bp, Homo sapiens; identical to SEQ ID NO: 4445

SEQ ID NO: 4592 - DNA, 201 bp, Homo sapiens; identical to SEQ ID NO: 4446

SEQ ID NO: 4593 - DNA, 201 bp, Homo sapiens; identical to SEQ ID NO: 4447

SEQ ID NO: 4594 - DNA, 201 bp, Homo sapiens; identical to SEQ ID NO: 4448

SEQ ID NO: 4595 - DNA, 201 bp, Homo sapiens
ggggatgcagtggctgaagacacaaggaaataagcaaatgctttgcacgtgcctgggcaacggagtcagctgccaagagacagctgtaacccagacttacrgtggcaactcaaatggagagccatgtgtcttaccattcacctacaatggcaggacgtgcagcacaacttcgaattatgagcaggaccagaaatactcttt

SEQ ID NO: 4596 - DNA, 201 bp, Homo sapiens; identical to SEQ ID NO: 4446

SEQ ID NO: 4597 - DNA, 201 bp, Homo sapiens; identical to SEQ ID NO: 4441

SEQ ID NO: 4598 - DNA, 201 bp, Homo sapiens; identical to SEQ ID NO: 4444

SEQ ID NO: 4599 - DNA, 201 bp, Homo sapiens; identical to SEQ ID NO: 4432

SEQ ID NO: 4600 - DNA, 201 bp, Homo sapiens; identical to SEQ ID NO: 4455

SEQ ID NO: 4601 - DNA, 201 bp, Homo sapiens; identical to SEQ ID NO: 4439

SEQ ID NO: 4602 - DNA, 201 bp, Homo sapiens; identical to SEQ ID NO: 4445

SEQ ID NO: 4603 - DNA, 201 bp, Homo sapiens; identical to SEQ ID NO: 4448

SEQ ID NO: 4604 - DNA, 201 bp, Homo sapiens; identical to SEQ ID NO: 4436

SEQ ID NO: 4605 - DNA, 201 bp, Homo sapiens; identical to SEQ ID NO: 4430

SEQ ID NO: 4606 - DNA, 201 bp, Homo sapiens; identical to SEQ ID NO: 4431

SEQ ID NO: 4607 - DNA, 201 bp, Homo sapiens; identical to SEQ ID NO: 4432

SEQ ID NO: 4608 - DNA, 201 bp, Homo sapiens; identical to SEQ ID NO: 4508

SEQ ID NO: 4609 - DNA, 201 bp, Homo sapiens; identical to SEQ ID NO: 4434

SEQ ID NO: 4610 - DNA, 201 bp, Homo sapiens; identical to SEQ ID NO: 4435

SEQ ID NO: 4611 - DNA, 201 bp, Homo sapiens; identical to SEQ ID NO: 4436

SEQ ID NO: 4612 - DNA, 201 bp, Homo sapiens; identical to SEQ ID NO: 4437

SEQ ID NO: 4613 - DNA, 201 bp, Homo sapiens; identical to SEQ ID NO: 4513

SEQ ID NO: 4614 - DNA, 201 bp, Homo sapiens; identical to SEQ ID NO: 4438

SEQ ID NO: 4615 - DNA, 201 bp, Homo sapiens; identical to SEQ ID NO: 4439

SEQ ID NO: 4616 - DNA, 201 bp, Homo sapiens; identical to SEQ ID NO: 4462

SEQ ID NO: 4617 - DNA, 201 bp, Homo sapiens; identical to SEQ ID NO: 4441

SEQ ID NO: 4618 - DNA, 201 bp, Homo sapiens; identical to SEQ ID NO: 4464

SEQ ID NO: 4619 - DNA, 201 bp, Homo sapiens; identical to SEQ ID NO: 4444

SEQ ID NO: 4620 - DNA, 201 bp, Homo sapiens; identical to SEQ ID NO: 4445

SEQ ID NO: 4621 - DNA, 201 bp, Homo sapiens; identical to SEQ ID NO: 4446

SEQ ID NO: 4622 - DNA, 201 bp, Homo sapiens; identical to SEQ ID NO: 4447

SEQ ID NO: 4623 - DNA, 201 bp, Homo sapiens; identical to SEQ ID NO: 4448

SEQ ID NO: 4624 - DNA, 201 bp, Homo sapiens; identical to SEQ ID NO: 4430

SEQ ID NO: 4625 - DNA, 201 bp, Homo sapiens; identical to SEQ ID NO: 4431

SEQ ID NO: 4626 - DNA, 201 bp, Homo sapiens; identical to SEQ ID NO: 4434

SEQ ID NO: 4627 - DNA, 201 bp, Homo sapiens; identical to SEQ ID NO: 4435

SEQ ID NO: 4628 - DNA, 201 bp, Homo sapiens; identical to SEQ ID NO: 4436

SEQ ID NO: 4629 - DNA, 201 bp, Homo sapiens; identical to SEQ ID NO: 4437

SEQ ID NO: 4630 - DNA, 201 bp, Homo sapiens; identical to SEQ ID NO: 4438

SEQ ID NO: 4631 - DNA, 201 bp, Homo sapiens
cggcctggagtacaatgtcagtgtttacactgtcaaggatgacaaggaaagtgtccctatctctgataccatcatcccagaggtgccccaactcactgacytaagctttgttgatataaccgattcaagcatcggcctgaggtggaccccgctaaactcttccaccattattgggtaccgcatcacagtagttgcggcagg

SEQ ID NO: 4632 - DNA, 201 bp, Homo sapiens; identical to SEQ ID NO: 4439

SEQ ID NO: 4633 - DNA, 201 bp, Homo sapiens; identical to SEQ ID NO: 4462

SEQ ID NO: 4634 - DNA, 201 bp, Homo sapiens; identical to SEQ ID NO: 4441

SEQ ID NO: 4635 - DNA, 201 bp, Homo sapiens
gtgtttacactgtcaaggatgacaaggaaagtgtccctatctctgataccatcatcccagaggtgccccaactcactgacctaagctttgttgatataacygattcaagcatcggcctgaggtggaccccgctaaactcttccaccattattgggtaccgcatcacagtagttgcggcaggagaaggtatccctatttttg

SEQ ID NO: 4636 - DNA, 201 bp, Homo sapiens; identical to SEQ ID NO: 4464

SEQ ID NO: 4637 - DNA, 201 bp, Homo sapiens; identical to SEQ ID NO: 4443

SEQ ID NO: 4638 - DNA, 201 bp, Homo sapiens; identical to SEQ ID NO: 4444

SEQ ID NO: 4639 - DNA, 201 bp, Homo sapiens; identical to SEQ ID NO: 4445

SEQ ID NO: 4640 - DNA, 201 bp, Homo sapiens; identical to SEQ ID NO: 4446

SEQ ID NO: 4641 - DNA, 201 bp, Homo sapiens; identical to SEQ ID NO: 4447

SEQ ID NO: 4642 - DNA, 201 bp, Homo sapiens
tgggccatggggtggagcagacagacttggagtttggaagccagatggaccaagcaaggagcctgactctgagctcaccagctgtgcaattcgggccaagrtcacatgtgcaccatggagggcaaaagacttggcggtttcgaaccctatggtttaaaggaaagtcaatgttagaaaacataacatcaacacaagaattcc

SEQ ID NO: 4643 - DNA, 201 bp, Homo sapiens
tccagtggtcacaatggactcgctcaagatactgtggccttgtgaccagccagaaatggacgaggtgccctcttatcccgagcagctcaaggaggaaaaargcatcttctccatttcagatgtgtctttctgggtgaagggatctccatttgcgttaacatccctgaccccctctgccactcacttattcctgctcaaggg

SEQ ID NO: 4644 - DNA, 131 bp, Homo sapiens
atgggccatggggtggagcagacagacttgsagtttggaagccagatggaccaagcaaggagcctgactctgagctcaccagctgtgcaattcgggccaagatcacatgtgcaccatggagggcaaaagac

SEQ ID NO: 4645 - DNA, 163 bp, Homo sapiens
atgggccatggggtggagcagacagacttggagtttggaagccagatggaccaagcaaggagmctgactctgagctcaccagctgtgcaattcgggccaagatcacatgtgcaccatggagggcaaaagacttggcggtttcgaaccctatggtttaaaggaa

SEQ ID NO: 4646 - DNA, 201 bp, Homo sapiens
ctcagtccacgttgatttctcctcatctgaatcacaaaggagcaggcatggaagtgttctgagcagcaattttacttaccacacgagtgatggagatgcaytgctccttctctgaagggaatcccaaagccttgtgtctacagagaacctggagttcctgaacctgatgctgactagtgaggaaagatttttgttgttatt

SEQ ID NO: 4647 - DNA, 201 bp, Homo sapiens
ttttggaagcatattcttcatcaccgtcatcagcattgataggtacctggccatcgtcctggccgccaactccatgaacaaccggaccgtgcagcatggcrtcaccatcagcctaggcgtctgggcagcagccattttggtggcagcaccccagttcatgttcacaaagcagaaagaaaatgaatgccttggtgactaccc

SEQ ID NO: 4648 - DNA, 201 bp, Homo sapiens
tacaacgttatgattttcctggagacgcttaagctctatgacttctttcccagttgtgacatgaggaaggatctgaggctggccctcagtgtgactgagayggttgcatttagccattgttgcctgaatcctctcatctatgcatttgctggggagaagttcagaagatacctttaccacctgtatgggaaatgcctggct

SEQ ID NO: 4649 - DNA, 201 bp, Homo sapiens
aagcagaaatacatatttccaagaagttggatgggtgggtactattctgattacacaaaacaaatgccacacatcacccttaccatgtgcctgatccagcytctcccctgattacaccagcctcgtcttcattaagccctcttccatcatgtccccaaacctgcaagggctccccactgcctactgcatcgagtcaaaact

SEQ ID NO: 4650 - DNA, 201 bp, Homo sapiens
ccagacgctgttttcctgcaagaaccacaagaaagccaaagccattaaactgatccttctggtggtcatcgtgtttttcctcttctggacaccctacaacrttatgattttcctggagacgcttaagctctatgacttctttcccagttgtgacatgaggaaggatctgaggctggccctcagtgtgactgagacggttgc

SEQ ID NO: 4651 - DNA, 201 bp, Homo sapiens
tctggcccgtgctccgcaatgtggaaacaaattttcttggcttcctactccccctgctcattatgagttattgctacttcagaatcatccagacgctgttytcctgcaagaaccacaagaaagccaaagccattaaactgatccttctggtggtcatcgtgtttttcctcttctggacaccctacaacgttatgattttcc

SEQ ID NO: 4652 - DNA, 201 bp, Homo sapiens
ctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcag

SEQ ID NO: 4653 - DNA, 201 bp, Homo sapiens
atcagaactttttggtttgcagatgacaaaaattcaactcagactagtttagttaaatgagggtggtgaatattgttcatattgtggcacaagcaaaaggrtgtctgagccctcaaagtgaggggaaaccagggcctgagccaagctagaattccctctctctgactctcaaatcttttagtcattatagatcccccagac

SEQ ID NO: 4654 - DNA, 201 bp, Homo sapiens
cgaggtcctccaggaaatctggcccgtgctccgcaatgtggaaacaaattttcttggcttcctactccccctgctcattatgagttattgctacttcagartcatccagacgctgttttcctgcaagaaccacaagaaagccaaagccattaaactgatccttctggtggtcatcgtgtttttcctcttctggacacccta

SEQ ID NO: 4655 - DNA, 201 bp, Homo sapiens
gggaaaataccccatcattcatgctactgccaacctggggagccagggctatgggagcagcttttttttcccccctagaaacgtttggaacaatctaaaastttaaagctcgaaaacaattgtaataatgctaaagaaaaagtcatccaatctaaccacatcaatattgtcattcctgtattcacccgtccagaccttgtt

SEQ ID NO: 4656 - DNA, 201 bp, Homo sapiens; identical to SEQ ID NO: 4646

SEQ ID NO: 4657 - DNA, 201 bp, Homo sapiens; identical to SEQ ID NO: 4647

SEQ ID NO: 4658 - DNA, 201 bp, Homo sapiens; identical to SEQ ID NO: 4648

SEQ ID NO: 4659 - DNA, 201 bp, Homo sapiens; identical to SEQ ID NO: 4649

SEQ ID NO: 4660 - DNA, 201 bp, Homo sapiens; identical to SEQ ID NO: 4650

SEQ ID NO: 4661 - DNA, 201 bp, Homo sapiens; identical to SEQ ID NO: 4651

SEQ ID NO: 4662 - DNA, 201 bp, Homo sapiens; identical to SEQ ID NO: 4652

SEQ ID NO: 4663 - DNA, 201 bp, Homo sapiens; identical to SEQ ID NO: 4653

SEQ ID NO: 4664 - DNA, 201 bp, Homo sapiens; identical to SEQ ID NO: 4654

SEQ ID NO: 4665 - DNA, 201 bp, Homo sapiens; identical to SEQ ID NO: 4655

SEQ ID NO: 4666 - DNA, 201 bp, Homo sapiens
ggaaatgggccttattccgttggttgtacagacttaatgtttgatcacactaataagggcaccttcttgcgtttatattatccatcccaagataatgatcrccttgacaccctttggatcccaaataaagaatatttttggggtcttagcaaatttcttggaacacactggcttatgggcaacattttgaggttactcttt

SEQ ID NO: 4667 - DNA, 201 bp, Homo sapiens
ccgcggcgggctaagttaaccgcgggtccaggagactaagctgaaactgctgctcagctcccaagatggtgccacccaaattgcatgtgcttttctgcctstgcggctgcctggctgtggtttatccttttgactggcaatacataaatcctgttgcccatatgaaatcatcagcatgggtcaacaaaatacaagtactga

SEQ ID NO: 4668 - DNA, 201 bp, Homo sapiens
gacttcacttttgcaactggcaaaataattggacacatgctcaaattaaagggagacatagattcaaatgcagctattgatcttagcaacaaagcttcatyagcattcttacaaaagcatttaggacttcataaagattttgatcagtgggactgcttgattgaaggagatgatgagaatcttattccagggaccaacatt

SEQ ID NO: 4669 - DNA, 201 bp, Homo sapiens
tcttcaggaatagagaaatacaattaggattaaaataggttttttaaaagtcttgtttcaaaactgtctaaaattatgtgtgtgtgtgtgtgtgtgtgtgwgagagagagagagagagagagagagagagaattttaatgtattttcccaaaggactcatattttaaaatgtaggctatactgtaatcgtgattgaagctt

SEQ ID NO: 4670 - DNA, 201 bp, Homo sapiens
ttcaggaatagagaaatacaattaggattaaaataggttttttaaaagtcttgtttcaaaactgtctaaaattatgtgtgtgtgtgtgtgtgtgtgtgtgwgagagagagagagagagagagagagagaattttaatgtattttcccaaaggactcatattttaaaatgtaggctatactgtaatcgtgattgaagcttgg

SEQ ID NO: 4671 - DNA, 201 bp, Homo sapiens
aaggagctggtgagcacgacaccacccaggcattgcctggctctctccgcggcgggctaagttaaccgcgggtccaggagactaagctgaaactgctgctyagctcccaagatggtgccacccaaattgcatgtgcttttctgcctctgcggctgcctggctgtggtttatccttttgactggcaatacataaatcctgtt

SEQ ID NO: 4672 - DNA, 201 bp, Homo sapiens
cagaactcttcaggaatagagaaatacaattaggattaaaataggttttttaaaagtcttgtttcaaaactgtctaaaattatgtgtgtgtgtgtgtgtgwgtgtgtgagagagagagagagagagagagagagagaattttaatgtattttcccaaaggactcatattttaaaatgtaggctatactgtaatcgtgattg

SEQ ID NO: 4673 - DNA, 201 bp, Homo sapiens
atcaggggttcagtccaccagaattttgctgacttcacttttgcaactggcaaaataattggacacatgctcaaattaaagggagacatagattcaaatgyagctattgatcttagcaacaaagcttcattagcattcttacaaaagcatttaggacttcataaagattttgatcagtgggactgcttgattgaaggagat

SEQ ID NO: 4674 - DNA, 201 bp, Homo sapiens
attgacctggcatctcatgggtttatagttgctgctgtagaacacagagatagatctgcatctgcaacttactatttcaaggaccaatctgctgcagaaayaggggacaagtcttggctctaccttagaaccctgaaacaagaggaggagacacatatacgaaatgagcaggtacggcaaagagcaaaagaatgttcccaa

SEQ ID NO: 4675 - DNA, 201 bp, Homo sapiens
ggaatagagaaatacaattaggattaaaataggttttttaaaagtcttgtttcaaaactgtctaaaattatgtgtgtgtgtgtgtgtgtgtgtgtgagagwgagagagagagagagagagagagaattttaatgtattttcccaaaggactcatattttaaaatgtaggctatactgtaatcgtgattgaagcttggacta

SEQ ID NO: 4676 - DNA, 201 bp, Homo sapiens
ctgactggggggtgaattcagcagggagtaaatctgatcggcatcaggtctgcggaaaggagctggtgagcacgacaccacccaggcattgcctggctctstccgcggcgggctaagttaaccgcgggtccaggagactaagctgaaactgctgctcagctcccaagatggtgccacccaaattgcatgtgcttttctgcc

SEQ ID NO: 4677 - DNA, 201 bp, Homo sapiens; identical to SEQ ID NO: 4666

SEQ ID NO: 4678 - DNA, 201 bp, Homo sapiens
gttcccgcgagcagctccgcgccgcgcctgagagactaagctgaaactgctgctcagctcccaagatggtgccacccaaattgcatgtgcttttctgcctstgcggctgcctggctgtggtttatccttttgactggcaatacataaatcctgttgcccatatgaaatcatcagcatgggtcaacaaaatacaagtactga

SEQ ID NO: 4679 - DNA, 201 bp, Homo sapiens; identical to SEQ ID NO: 4668

SEQ ID NO: 4680 - DNA, 201 bp, Homo sapiens; identical to SEQ ID NO: 4669

SEQ ID NO: 4681 - DNA, 201 bp, Homo sapiens; identical to SEQ ID NO: 4670

SEQ ID NO: 4682 - DNA, 112 bp, Homo sapiens
cctcctccagcwtcaccaggggaggagagggtcggggccacaaggccgcgctaggcggacccaggacacagcccgcgcgcagcccacccgcccgccgcctgccagagctgct

SEQ ID NO: 4683 - DNA, 201 bp, Homo sapiens
cgcttgggtcgcgttggtgcgcggtggaacgcgcccagggaccccagttcccgcgagcagctccgcgccgcgcctgagagactaagctgaaactgctgctyagctcccaagatggtgccacccaaattgcatgtgcttttctgcctctgcggctgcctggctgtggtttatccttttgactggcaatacataaatcctgtt

SEQ ID NO: 4684 - DNA, 201 bp, Homo sapiens; identical to SEQ ID NO: 4672

SEQ ID NO: 4685 - DNA, 201 bp, Homo sapiens; identical to SEQ ID NO: 4673

SEQ ID NO: 4686 - DNA, 201 bp, Homo sapiens; identical to SEQ ID NO: 4674

SEQ ID NO: 4687 - DNA, 201 bp, Homo sapiens; identical to SEQ ID NO: 4675

SEQ ID NO: 4688 - DNA, 201 bp, Homo sapiens
cagttttgggaacaccgacaaacccagccctggcgctgagcctctctaccccaggtcagacggacagaaagacagatcacaggtacagggatgaggacacyggctctgaccaggagtttggggagcttcaggacattgctgtgctttggggattccctccacatgctgcacgcgcatctcgcccccaggggcactgcctgg

SEQ ID NO: 4689 - DNA, 201 bp, Homo sapiens
tgagatgtatcttttgctctctcttgctctcttatttgtaccggtttttcttatcttgaacagatatttaattttgctaacactcagctctgccctccccratcccctggctccccagcacacattcctttgaaataaggtttcaatatacatctacatactatatatatatttggcaacttgtatttgtgtgtttatgta

SEQ ID NO: 4690 - DNA, 201 bp, Homo sapiens
ccagaaacctgaaatgaaggaagaggagactctgcgcagagcactttgggtccggagggcgagactccggcggaagcattcccgggcgggtgacccagcayggtccctcttggaattggattcgccattttatttttcttgctgctaaatcaccgagcccggaagattagagagttttatttctgggattcctgtagacac

SEQ ID NO: 4691 - DNA, 201 bp, Homo sapiens
ggggaggaagagtagctcgccgaggcgccgaggagagcgggccgccccacagcccgagccggagagggagcgcgagccgcgccggccccggtcgggcctcygaaaccatgaactttctgctgtcttgggtgcattggagccttgccttgctgctctacctccaccatgccaagtggtcccaggctgcacccatggcagaag

SEQ ID NO: 4692 - DNA, 201 bp, Homo sapiens
cggtgagccgggcaggaggaaggagcctccctcagggtttcgggaaccagatctctcaccaggaaagactgatacagaacgatcgatacagaaaccacgcygccgccaccacaccatcaccatcgacagaacagtccttaatccagaaacctgaaatgaaggaagaggagactctgcgcagagcactttgggtccggaggg

SEQ ID NO: 4693 - DNA, 201 bp, Homo sapiens
accagcagaaagaggaaagaggtagcaagagctccagagagaagtcgaggaagagagagacggggtcagagagagcgcgcgggcgtgcgagcagcgaaagsgacaggggcaaagtgagtgacctgcttttgggggtgaccgccggagcgcggcgtgagccctcccccttgggatcccgcagctgaccagtcgcgctgacgg

SEQ ID NO: 4694 - DNA, 201 bp, Homo sapiens
cctatgtcctcacaccattgaaaccactagttctgtccccccaggagacctggttgtgtgtgtgtgagtggttgaccttcctccatcccctggtccttccyttcccttcccgaggcacagagagacagggcaggatccacgtgcccattgtggaggcagagaaaagagaaagtgttttatatacggtacttatttaatatc

SEQ ID NO: 4695 - DNA, 201 bp, Homo sapiens
gaggcttggggcagccgggtagctcggaggtcgtggcgctgggggctagcaccagcgctctgtcgggaggcgcagcggttaggtggaccggtcagcggacycaccggccagggcgctcggtgctggaatttgatattcattgatccgggttttatccctcttcttttttcttaaacatttttttttaaaactgtattgttt

SEQ ID NO: 4696 - DNA, 201 bp, Homo sapiens
gtcccggcgaagagaagagacacattgttggaagaagcagcccatgacagctccccttcctgggactcgccctcatcctcttcctgctccccttcctgggrtgcagcctaaaaggacctatgtcctcacaccattgaaaccactagttctgtccccccaggagacctggttgtgtgtgtgtgagtggttgaccttcctcca

SEQ ID NO: 4697 - DNA, 201 bp, Homo sapiens
cctggaagattcaggagcctgggcggccttcgcttactctcacctgcttctgagttgcccaggagaccactggcagatgtcccggcgaagagaagagacayattgttggaagaagcagcccatgacagctccccttcctgggactcgccctcatcctcttcctgctccccttcctggggtgcagcctaaaaggacctatgt

SEQ ID NO: 4698 - DNA, 201 bp, Homo sapiens
catgctgcacgcgcatctcgcccccaggggcactgcctggaagattcaggagcctgggcggccttcgcttactctcacctgcttctgagttgcccaggagrccactggcagatgtcccggcgaagagaagagacacattgttggaagaagcagcccatgacagctccccttcctgggactcgccctcatcctcttcctgct

SEQ ID NO: 4699 - DNA, 201 bp, Homo sapiens; identical to SEQ ID NO: 4688

SEQ ID NO: 4700 - DNA, 201 bp, Homo sapiens; identical to SEQ ID NO: 4689

SEQ ID NO: 4701 - DNA, 201 bp, Homo sapiens; identical to SEQ ID NO: 4690

SEQ ID NO: 4702 - DNA, 201 bp, Homo sapiens; identical to SEQ ID NO: 4691

SEQ ID NO: 4703 - DNA, 201 bp, Homo sapiens; identical to SEQ ID NO: 4692

SEQ ID NO: 4704 - DNA, 201 bp, Homo sapiens; identical to SEQ ID NO: 4693

SEQ ID NO: 4705 - DNA, 201 bp, Homo sapiens; identical to SEQ ID NO: 4694

SEQ ID NO: 4706 - DNA, 201 bp, Homo sapiens; identical to SEQ ID NO: 4695

SEQ ID NO: 4707 - DNA, 201 bp, Homo sapiens; identical to SEQ ID NO: 4696

SEQ ID NO: 4708 - DNA, 201 bp, Homo sapiens; identical to SEQ ID NO: 4697

SEQ ID NO: 4709 - DNA, 201 bp, Homo sapiens; identical to SEQ ID NO: 4698

SEQ ID NO: 4710 - DNA, 201 bp, Homo sapiens; identical to SEQ ID NO: 4688

SEQ ID NO: 4711 - DNA, 201 bp, Homo sapiens
aaaattcatgtttccaatctctctctccctgatcggtgacagtcactagcttatcttgaacagatatttaattttgctaacactcagctctgccctccccratcccctggctccccagcacacattcctttgaaataaggtttcaatatacatctacatactatatatatatttggcaacttgtatttgtgtgtatatata

SEQ ID NO: 4712 - DNA, 201 bp, Homo sapiens; identical to SEQ ID NO: 4690

SEQ ID NO: 4713 - DNA, 201 bp, Homo sapiens; identical to SEQ ID NO: 4691

SEQ ID NO: 4714 - DNA, 201 bp, Homo sapiens; identical to SEQ ID NO: 4692

SEQ ID NO: 4715 - DNA, 201 bp, Homo sapiens; identical to SEQ ID NO: 4693

SEQ ID NO: 4716 - DNA, 201 bp, Homo sapiens; identical to SEQ ID NO: 4694

SEQ ID NO: 4717 - DNA, 201 bp, Homo sapiens; identical to SEQ ID NO: 4695

SEQ ID NO: 4718 - DNA, 201 bp, Homo sapiens
tggctccccagcacacattcctttgaaataaggtttcaatatacatctacatactatatatatatttggcaacttgtatttgtgtgtatatatatatatayatgtttatgtatatatgtgattctgataaaatagacattgctattctgttttttatatgtaaaaacaaaacaagaaaaaatagagaattctacatactaa

SEQ ID NO: 4719 - DNA, 201 bp, Homo sapiens; identical to SEQ ID NO: 4696

SEQ ID NO: 4720 - DNA, 201 bp, Homo sapiens; identical to SEQ ID NO: 4697

SEQ ID NO: 4721 - DNA, 201 bp, Homo sapiens; identical to SEQ ID NO: 4698

SEQ ID NO: 4722 - DNA, 201 bp, Homo sapiens; identical to SEQ ID NO: 4693

SEQ ID NO: 4723 - DNA, 201 bp, Homo sapiens; identical to SEQ ID NO: 4695

SEQ ID NO: 4724 - DNA, 201 bp, Homo sapiens; identical to SEQ ID NO: 4691

SEQ ID NO: 4725 - DNA, 201 bp, Homo sapiens; identical to SEQ ID NO: 4688

SEQ ID NO: 4726 - DNA, 201 bp, Homo sapiens; identical to SEQ ID NO: 4711

SEQ ID NO: 4727 - DNA, 201 bp, Homo sapiens; identical to SEQ ID NO: 4690

SEQ ID NO: 4728 - DNA, 201 bp, Homo sapiens; identical to SEQ ID NO: 4691

SEQ ID NO: 4729 - DNA, 201 bp, Homo sapiens; identical to SEQ ID NO: 4692

SEQ ID NO: 4730 - DNA, 201 bp, Homo sapiens; identical to SEQ ID NO: 4693

SEQ ID NO: 4731 - DNA, 201 bp, Homo sapiens; identical to SEQ ID NO: 4694

SEQ ID NO: 4732 - DNA, 201 bp, Homo sapiens; identical to SEQ ID NO: 4695

SEQ ID NO: 4733 - DNA, 201 bp, Homo sapiens; identical to SEQ ID NO: 4718

SEQ ID NO: 4734 - DNA, 201 bp, Homo sapiens; identical to SEQ ID NO: 4696

SEQ ID NO: 4735 - DNA, 201 bp, Homo sapiens; identical to SEQ ID NO: 4697

SEQ ID NO: 4736 - DNA, 201 bp, Homo sapiens; identical to SEQ ID NO: 4698

SEQ ID NO: 4737 - DNA, 201 bp, Homo sapiens; identical to SEQ ID NO: 4688

SEQ ID NO: 4738 - DNA, 201 bp, Homo sapiens
aaaattcatgtttccaatctctctctccctgatcggtgacagtcactagcttatcttgaacagatatttaattttgctaacactcagctctgccctccccratcccctggctccccagcacacattcctttgaaataaggtttcaatatacatctacatactatatatatatttggcaacttgtatttgtgtgtttatgta

SEQ ID NO: 4739 - DNA, 201 bp, Homo sapiens
ccagaaacctgaaatgaaggaagaggagactctgcgcagagcactttgggtccggagggcgagactccggcggaagcattcccgggcgggtgacccagcayggtccctcttggaattggattcgccattttatttttcttgctgctaaatcaccgagcccggacacatacatacatttatatatatatatattatatatat

SEQ ID NO: 4740 - DNA, 201 bp, Homo sapiens; identical to SEQ ID NO: 4691

SEQ ID NO: 4741 - DNA, 201 bp, Homo sapiens; identical to SEQ ID NO: 4692

SEQ ID NO: 4742 - DNA, 201 bp, Homo sapiens; identical to SEQ ID NO: 4693

SEQ ID NO: 4743 - DNA, 201 bp, Homo sapiens; identical to SEQ ID NO: 4694

SEQ ID NO: 4744 - DNA, 201 bp, Homo sapiens; identical to SEQ ID NO: 4695

SEQ ID NO: 4745 - DNA, 201 bp, Homo sapiens; identical to SEQ ID NO: 4696

SEQ ID NO: 4746 - DNA, 201 bp, Homo sapiens; identical to SEQ ID NO: 4697

SEQ ID NO: 4747 - DNA, 201 bp, Homo sapiens; identical to SEQ ID NO: 4698

SEQ ID NO: 4748 - DNA, 201 bp, Homo sapiens; identical to SEQ ID NO: 4688

SEQ ID NO: 4749 - DNA, 201 bp, Homo sapiens; identical to SEQ ID NO: 4711

SEQ ID NO: 4750 - DNA, 201 bp, Homo sapiens; identical to SEQ ID NO: 4690

SEQ ID NO: 4751 - DNA, 201 bp, Homo sapiens; identical to SEQ ID NO: 4691

SEQ ID NO: 4752 - DNA, 201 bp, Homo sapiens; identical to SEQ ID NO: 4692

SEQ ID NO: 4753 - DNA, 201 bp, Homo sapiens; identical to SEQ ID NO: 4693

SEQ ID NO: 4754 - DNA, 201 bp, Homo sapiens; identical to SEQ ID NO: 4694

SEQ ID NO: 4755 - DNA, 201 bp, Homo sapiens; identical to SEQ ID NO: 4695

SEQ ID NO: 4756 - DNA, 201 bp, Homo sapiens; identical to SEQ ID NO: 4718

SEQ ID NO: 4757 - DNA, 201 bp, Homo sapiens; identical to SEQ ID NO: 4696

SEQ ID NO: 4758 - DNA, 201 bp, Homo sapiens; identical to SEQ ID NO: 4697

SEQ ID NO: 4759 - DNA, 201 bp, Homo sapiens; identical to SEQ ID NO: 4698

SEQ ID NO: 4760 - DNA, 201 bp, Homo sapiens
ccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaa

SEQ ID NO: 4761 - DNA, 201 bp, Homo sapiens
ttgaatcctctctctgtgttacccagtaactcatctgtcaccaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttg

SEQ ID NO: 4762 - DNA, 201 bp, Homo sapiens
accttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtacactgcacgaatggaagaggcacctgtcccagaaaaagcat

SEQ ID NO: 4763 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcagccctcaccgtctggcaccctagtcattggagtcatcagtg

SEQ ID NO: 4764 - DNA, 201 bp, Homo sapiens
tcatcagtggaattgctgtttttgtcgtcatcttgttcattggaattttgttcataatattaaggaagaggcagggttcaagaggagccatggggcactaygtcttagctgaacgtgagtgacacgcagcctgcagactcactgtgggaaggagacaaaactagagactcaaagagggagtgcatttatgagctcttcatg

SEQ ID NO: 4765 - DNA, 201 bp, Homo sapiens
ctgcagccctcaccgtctggcaccctagtcattggagtcatcagtggaattgctgtttttgtcgtcatcttgttcattggaattttgttcataatattaakgaagaggcagggttcaagaggagccatggggcactacgtcttagctgaacgtgagtgacacgcagcctgcagactcactgtgggaaggagacaaaactag

SEQ ID NO: 4766 - DNA, 201 bp, Homo sapiens
gcgttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 4767 - DNA, 201 bp, Homo sapiens
cctcttcatgggtgcctcagagcaggaccttggtctttccttgtttgaagctttgggctacgtggatgaccagctgttcgtgttctatgatcatgagagtygccgtgtggagccccgaactccatgggtttccagtagaatttcaagccagatgtggctgcagctgagtcagagtctgaaagggtgggatcacatgttcac

SEQ ID NO: 4768 - DNA, 201 bp, Homo sapiens
tctgcactacctcttcatgggtgcctcagagcaggaccttggtctttccttgtttgaagctttgggctacgtggatgaccagctgttcgtgttctatgatsatgagagtcgccgtgtggagccccgaactccatgggtttccagtagaatttcaagccagatgtggctgcagctgagtcagagtctgaaagggtgggatca

SEQ ID NO: 4769 - DNA, 201 bp, Homo sapiens
ctgcagctgagtcagagtctgaaagggtgggatcacatgttcactgttgacttctggactattatggaaaatcacaaccacagcaaggtgaccactctacrgtgtcgggccttgaactactacccccagaacatcaccatgaagtggctgaaggataagcagccaatggatgccaaggagttcgaacctaaagacgtattg

SEQ ID NO: 4770 - DNA, 201 bp, Homo sapiens; identical to SEQ ID NO: 4762

SEQ ID NO: 4771 - DNA, 201 bp, Homo sapiens
gtggctgaaggataagcagccaatggatgccaaggagttcgaacctaaagacgtattgcccaatggggatgggacctaccagggctggataaccttggctktaccccctggggaagagcagagatatacgtgccaggtggagcacccaggcctggatcagcccctcattgtgatctgggagccctcaccgtctggcaccct

SEQ ID NO: 4772 - DNA, 201 bp, Homo sapiens
gcagccaatggatgccaaggagttcgaacctaaagacgtattgcccaatggggatgggacctaccagggctggataaccttggctgtaccccctggggaaragcagagatatacgtgccaggtggagcacccaggcctggatcagcccctcattgtgatctgggagccctcaccgtctggcaccctagtcattggagtcat

SEQ ID NO: 4773 - DNA, 201 bp, Homo sapiens
gggacctaccagggctggataaccttggctgtaccccctggggaagagcagagatatacgtgccaggtggagcacccaggcctggatcagcccctcattgygatctgggagccctcaccgtctggcaccctagtcattggagtcatcagtggaattgctgtttttgtcgtcatcttgttcattggaattttgttcataata

SEQ ID NO: 4774 - DNA, 201 bp, Homo sapiens
ggcccgcgagccaggccggcgcttctcctcctgatgcttttgcagaccgcggtcctgcaggggcgcttgctgcgttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 4775 - DNA, 201 bp, Homo sapiens
cctgcaggggcgcttgctgcgttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 4776 - DNA, 201 bp, Homo sapiens
tgcactacctcttcatgggtgcctcagagcaggaccttggtctttccttgtttgaagctttgggctacgtggatgaccagctgttcgtgttctatgatcaygagagtcgccgtgtggagccccgaactccatgggtttccagtagaatttcaagccagatgtggctgcagctgagtcagagtctgaaagggtgggatcaca

SEQ ID NO: 4777 - DNA, 201 bp, Homo sapiens; identical to SEQ ID NO: 4760

SEQ ID NO: 4778 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgaccactctacggtgtcgggccttgaactactaccc

SEQ ID NO: 4779 - DNA, 201 bp, Homo sapiens; identical to SEQ ID NO: 4764

SEQ ID NO: 4780 - DNA, 201 bp, Homo sapiens
tgggagccctcaccgtctggcaccctagtcattggagtcatcagtggaattgctgtttttgtcgtcatcttgttcattggaattttgttcataatattaakgaagaggcagggttcaagaggagccatggggcactacgtcttagctgaacgtgagtgacacgcagcctgcagactcactgtgggaaggagacaaaactag

SEQ ID NO: 4781 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctgggagccctcaccgtctggcaccctagtcattggagtcatcagtggaattgctgtt

SEQ ID NO: 4782 - DNA, 201 bp, Homo sapiens
ctcagagcaggaccttggtctttccttgtttgaagctttgggctacgtggatgaccagctgttcgtgttctatgatcatgagagtcgccgtgtggagcccygaactccatgggtttccagtagaatttcaagccagatgtggctgcagctgagtcagagtctgaaagggtgggatcacatgttcactgttgacttctggac

SEQ ID NO: 4783 - DNA, 201 bp, Homo sapiens; identical to SEQ ID NO: 4761

SEQ ID NO: 4784 - DNA, 201 bp, Homo sapiens
gagttcgaacctaaagacgtattgcccaatggggatgggacctaccagggctggataaccttggctgtaccccctggggaagagcagagatatacgtgccmggtggagcacccaggcctggatcagcccctcattgtgatctgggagccctcaccgtctggcaccctagtcattggagtcatcagtggaattgctgttttt

SEQ ID NO: 4785 - DNA, 201 bp, Homo sapiens
ctacctcttcatgggtgcctcagagcaggaccttggtctttccttgtttgaagctttgggctacgtggatgaccagctgttcgtgttctatgatcatgagwgtcgccgtgtggagccccgaactccatgggtttccagtagaatttcaagccagatgtggctgcagctgagtcagagtctgaaagggtgggatcacatgtt

SEQ ID NO: 4786 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcgttcacactctctgcactacctcttcatgggtgcctcagagc

SEQ ID NO: 4787 - DNA, 201 bp, Homo sapiens; identical to SEQ ID NO: 4766

SEQ ID NO: 4788 - DNA, 201 bp, Homo sapiens; identical to SEQ ID NO: 4767

SEQ ID NO: 4789 - DNA, 201 bp, Homo sapiens; identical to SEQ ID NO: 4768

SEQ ID NO: 4790 - DNA, 201 bp, Homo sapiens
ctgcagcagttgctggagctggggagaggtgttttggaccaacaagtgcctcctttggtgaaggtgacacatcatgtgacctcttcagtgaccactctacrgtgtcgggccttgaactactacccccagaacatcaccatgaagtggctgaaggataagcagccaatggatgccaaggagttcgaacctaaagacgtattg

SEQ ID NO: 4791 - DNA, 201 bp, Homo sapiens; identical to SEQ ID NO: 4762

SEQ ID NO: 4792 - DNA, 201 bp, Homo sapiens; identical to SEQ ID NO: 4771

SEQ ID NO: 4793 - DNA, 201 bp, Homo sapiens; identical to SEQ ID NO: 4772

SEQ ID NO: 4794 - DNA, 201 bp, Homo sapiens; identical to SEQ ID NO: 4773

SEQ ID NO: 4795 - DNA, 201 bp, Homo sapiens; identical to SEQ ID NO: 4774

SEQ ID NO: 4796 - DNA, 201 bp, Homo sapiens; identical to SEQ ID NO: 4775

SEQ ID NO: 4797 - DNA, 111 bp, Homo sapiens
aagctgttatttaattagccagtgaaaaactattaacaacttgtctattacctgttagtattattgttgcattaaaaatgcatatactttaataaatgtayattgtattgt

SEQ ID NO: 4798 - DNA, 201 bp, Homo sapiens; identical to SEQ ID NO: 4776

SEQ ID NO: 4799 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggagtcccacaccctgcaggtcatcctgggctgtgaaat

SEQ ID NO: 4800 - DNA, 201 bp, Homo sapiens
ctactggaagtacgggtatgatgggcaggaccaccttgaattctgccctgacacactggattggagagcagcagaacccagggcctggcccaccaagctgbagtgggaaaggcacaagattcgggccaggcagaacagggcctacctggagagggactgccctgcacagctgcagcagttgctggagctggggagaggtgt

SEQ ID NO: 4801 - DNA, 201 bp, Homo sapiens
tggaagtacgggtatgatgggcaggaccaccttgaattctgccctgacacactggattggagagcagcagaacccagggcctggcccaccaagctggagtrggaaaggcacaagattcgggccaggcagaacagggcctacctggagagggactgccctgcacagctgcagcagttgctggagctggggagaggtgttttg

SEQ ID NO: 4802 - DNA, 201 bp, Homo sapiens
gagagggactgccctgcacagctgcagcagttgctggagctggggagaggtgttttggaccaacaagtgcctcctttggtgaaggtgacacatcatgtgayctcttcagtgaccactctacggtgtcgggccttgaactactacccccagaacatcaccatgaagtggctgaaggataagcagccaatggatgccaaggag

SEQ ID NO: 4803 - DNA, 201 bp, Homo sapiens; identical to SEQ ID NO: 4764

SEQ ID NO: 4804 - DNA, 201 bp, Homo sapiens; identical to SEQ ID NO: 4780

SEQ ID NO: 4805 - DNA, 201 bp, Homo sapiens; identical to SEQ ID NO: 4781

SEQ ID NO: 4806 - DNA, 201 bp, Homo sapiens; identical to SEQ ID NO: 4782

SEQ ID NO: 4807 - DNA, 201 bp, Homo sapiens; identical to SEQ ID NO: 4761

SEQ ID NO: 4808 - DNA, 201 bp, Homo sapiens; identical to SEQ ID NO: 4784

SEQ ID NO: 4809 - DNA, 201 bp, Homo sapiens; identical to SEQ ID NO: 4785

SEQ ID NO: 4810 - DNA, 201 bp, Homo sapiens; identical to SEQ ID NO: 4786

SEQ ID NO: 4811 - DNA, 201 bp, Homo sapiens
caccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttt

SEQ ID NO: 4812 - DNA, 201 bp, Homo sapiens; identical to SEQ ID NO: 4766

SEQ ID NO: 4813 - DNA, 201 bp, Homo sapiens
tacgtgccaggtggagcacccaggcctggatcagcccctcattgtgatctggggtatgtgactgatgagagccaggagctgagaaaatctattgggggttragaggagtgcctgaggagagccctcaccgtctggcaccctagtcattggagtcatcagtggaattgctgtttttgtcgtcatcttgttcattggaatttt

SEQ ID NO: 4814 - DNA, 201 bp, Homo sapiens; identical to SEQ ID NO: 4767

SEQ ID NO: 4815 - DNA, 201 bp, Homo sapiens
agggtaaacagatcccctctcctcatccttcctctttcctgtcaagtgcctcctttggtgaaggtgacacatcatgtgacctcttcagtgaccactctacrgtgtcgggccttgaactactacccccagaacatcaccatgaagtggctgaaggataagcagccaatggatgccaaggagttcgaacctaaagacgtattg

SEQ ID NO: 4816 - DNA, 201 bp, Homo sapiens; identical to SEQ ID NO: 4768

SEQ ID NO: 4817 - DNA, 201 bp, Homo sapiens; identical to SEQ ID NO: 4762

SEQ ID NO: 4818 - DNA, 201 bp, Homo sapiens
gtggctgaaggataagcagccaatggatgccaaggagttcgaacctaaagacgtattgcccaatggggatgggacctaccagggctggataaccttggctktaccccctggggaagagcagagatatacgtgccaggtggagcacccaggcctggatcagcccctcattgtgatctggggtatgtgactgatgagagccag

SEQ ID NO: 4819 - DNA, 201 bp, Homo sapiens
gcagccaatggatgccaaggagttcgaacctaaagacgtattgcccaatggggatgggacctaccagggctggataaccttggctgtaccccctggggaaragcagagatatacgtgccaggtggagcacccaggcctggatcagcccctcattgtgatctggggtatgtgactgatgagagccaggagctgagaaaatct

SEQ ID NO: 4820 - DNA, 201 bp, Homo sapiens
gggacctaccagggctggataaccttggctgtaccccctggggaagagcagagatatacgtgccaggtggagcacccaggcctggatcagcccctcattgygatctggggtatgtgactgatgagagccaggagctgagaaaatctattgggggttgagaggagtgcctgaggagagccctcaccgtctggcaccctagtc

SEQ ID NO: 4821 - DNA, 201 bp, Homo sapiens; identical to SEQ ID NO: 4774

SEQ ID NO: 4822 - DNA, 201 bp, Homo sapiens; identical to SEQ ID NO: 4775

SEQ ID NO: 4823 - DNA, 201 bp, Homo sapiens; identical to SEQ ID NO: 4776

SEQ ID NO: 4824 - DNA, 201 bp, Homo sapiens; identical to SEQ ID NO: 4760

SEQ ID NO: 4825 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggaaggaagtgaaagttccagtcttcctggcaagggtaa

SEQ ID NO: 4826 - DNA, 201 bp, Homo sapiens
aaagttccagtcttcctggcaagggtaaacagatcccctctcctcatccttcctctttcctgtcaagtgcctcctttggtgaaggtgacacatcatgtgayctcttcagtgaccactctacggtgtcgggccttgaactactacccccagaacatcaccatgaagtggctgaaggataagcagccaatggatgccaaggag

SEQ ID NO: 4827 - DNA, 201 bp, Homo sapiens; identical to SEQ ID NO: 4764

SEQ ID NO: 4828 - DNA, 201 bp, Homo sapiens
ggagagccctcaccgtctggcaccctagtcattggagtcatcagtggaattgctgtttttgtcgtcatcttgttcattggaattttgttcataatattaakgaagaggcagggttcaagaggagccatggggcactacgtcttagctgaacgtgagtgacacgcagcctgcagactcactgtgggaaggagacaaaactag

SEQ ID NO: 4829 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctggggtatgtgactgatgagagccaggagctgagaaaatctattgggggttgagagg

SEQ ID NO: 4830 - DNA, 201 bp, Homo sapiens; identical to SEQ ID NO: 4782

SEQ ID NO: 4831 - DNA, 201 bp, Homo sapiens; identical to SEQ ID NO: 4761

SEQ ID NO: 4832 - DNA, 201 bp, Homo sapiens; identical to SEQ ID NO: 4785

SEQ ID NO: 4833 - DNA, 201 bp, Homo sapiens
gagttcgaacctaaagacgtattgcccaatggggatgggacctaccagggctggataaccttggctgtaccccctggggaagagcagagatatacgtgccmggtggagcacccaggcctggatcagcccctcattgtgatctggggtatgtgactgatgagagccaggagctgagaaaatctattgggggttgagaggagt

SEQ ID NO: 4834 - DNA, 201 bp, Homo sapiens; identical to SEQ ID NO: 4786

SEQ ID NO: 4835 - DNA, 201 bp, Homo sapiens
gtctgaaagggtgggatcacatgttcactgttgacttctggactattatggaaaatcacaaccacagcaaggaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 4836 - DNA, 201 bp, Homo sapiens; identical to SEQ ID NO: 4801

SEQ ID NO: 4837 - DNA, 201 bp, Homo sapiens; identical to SEQ ID NO: 4802

SEQ ID NO: 4838 - DNA, 201 bp, Homo sapiens; identical to SEQ ID NO: 4790

SEQ ID NO: 4839 - DNA, 201 bp, Homo sapiens; identical to SEQ ID NO: 4762

SEQ ID NO: 4840 - DNA, 201 bp, Homo sapiens; identical to SEQ ID NO: 4771

SEQ ID NO: 4841 - DNA, 201 bp, Homo sapiens; identical to SEQ ID NO: 4764

SEQ ID NO: 4842 - DNA, 201 bp, Homo sapiens; identical to SEQ ID NO: 4772

SEQ ID NO: 4843 - DNA, 201 bp, Homo sapiens; identical to SEQ ID NO: 4780

SEQ ID NO: 4844 - DNA, 201 bp, Homo sapiens; identical to SEQ ID NO: 4773

SEQ ID NO: 4845 - DNA, 201 bp, Homo sapiens; identical to SEQ ID NO: 4781

SEQ ID NO: 4846 - DNA, 201 bp, Homo sapiens; identical to SEQ ID NO: 4760

SEQ ID NO: 4847 - DNA, 201 bp, Homo sapiens; identical to SEQ ID NO: 4761

SEQ ID NO: 4848 - DNA, 201 bp, Homo sapiens; identical to SEQ ID NO: 4784

SEQ ID NO: 4849 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcagtcccacaccctgcaggtcatcctgggctgtgaaatgcaag

SEQ ID NO: 4850 - DNA, 201 bp, Homo sapiens; identical to SEQ ID NO: 4800

SEQ ID NO: 4851 - DNA, 201 bp, Homo sapiens
cccgcgagccaggccggcgcttctcctcctgatgcttttgcagaccgcggtcctgcaggggcgcttgctgcctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 4852 - DNA, 201 bp, Homo sapiens
tctcctcctgatgcttttgcagaccgcggtcctgcaggggcgcttgctgcctttgggctacgtggatgaccagctgttcgtgttctatgatcatgagagtygccgtgtggagccccgaactccatgggtttccagtagaatttcaagccagatgtggctgcagctgagtcagagtctgaaagggtgggatcacatgttcac

SEQ ID NO: 4853 - DNA, 201 bp, Homo sapiens
gccggcgcttctcctcctgatgcttttgcagaccgcggtcctgcaggggcgcttgctgcctttgggctacgtggatgaccagctgttcgtgttctatgatsatgagagtcgccgtgtggagccccgaactccatgggtttccagtagaatttcaagccagatgtggctgcagctgagtcagagtctgaaagggtgggatca

SEQ ID NO: 4854 - DNA, 201 bp, Homo sapiens; identical to SEQ ID NO: 4790

SEQ ID NO: 4855 - DNA, 201 bp, Homo sapiens; identical to SEQ ID NO: 4762

SEQ ID NO: 4856 - DNA, 201 bp, Homo sapiens; identical to SEQ ID NO: 4771

SEQ ID NO: 4857 - DNA, 201 bp, Homo sapiens; identical to SEQ ID NO: 4772

SEQ ID NO: 4858 - DNA, 201 bp, Homo sapiens; identical to SEQ ID NO: 4773

SEQ ID NO: 4859 - DNA, 201 bp, Homo sapiens
cagagctggggaaatgggcccgcgagccaggccggcgcttctcctcctgatgcttttgcagaccgcggtcctgcaggggcgcttgctgcctttgggctacrtggatgaccagctgttcgtgttctatgatcatgagagtcgccgtgtggagccccgaactccatgggtttccagtagaatttcaagccagatgtggctgca

SEQ ID NO: 4860 - DNA, 201 bp, Homo sapiens
cggcgcttctcctcctgatgcttttgcagaccgcggtcctgcaggggcgcttgctgcctttgggctacgtggatgaccagctgttcgtgttctatgatcaygagagtcgccgtgtggagccccgaactccatgggtttccagtagaatttcaagccagatgtggctgcagctgagtcagagtctgaaagggtgggatcaca

SEQ ID NO: 4861 - DNA, 201 bp, Homo sapiens; identical to SEQ ID NO: 4760

SEQ ID NO: 4862 - DNA, 201 bp, Homo sapiens; identical to SEQ ID NO: 4799

SEQ ID NO: 4863 - DNA, 201 bp, Homo sapiens; identical to SEQ ID NO: 4800

SEQ ID NO: 4864 - DNA, 201 bp, Homo sapiens; identical to SEQ ID NO: 4801

SEQ ID NO: 4865 - DNA, 201 bp, Homo sapiens; identical to SEQ ID NO: 4802

SEQ ID NO: 4866 - DNA, 201 bp, Homo sapiens; identical to SEQ ID NO: 4764

SEQ ID NO: 4867 - DNA, 201 bp, Homo sapiens; identical to SEQ ID NO: 4780

SEQ ID NO: 4868 - DNA, 201 bp, Homo sapiens; identical to SEQ ID NO: 4781

SEQ ID NO: 4869 - DNA, 201 bp, Homo sapiens
tttgcagaccgcggtcctgcaggggcgcttgctgcctttgggctacgtggatgaccagctgttcgtgttctatgatcatgagagtcgccgtgtggagcccygaactccatgggtttccagtagaatttcaagccagatgtggctgcagctgagtcagagtctgaaagggtgggatcacatgttcactgttgacttctggac

SEQ ID NO: 4870 - DNA, 201 bp, Homo sapiens; identical to SEQ ID NO: 4761

SEQ ID NO: 4871 - DNA, 201 bp, Homo sapiens; identical to SEQ ID NO: 4784

SEQ ID NO: 4872 - DNA, 201 bp, Homo sapiens
gcttctcctcctgatgcttttgcagaccgcggtcctgcaggggcgcttgctgcctttgggctacgtggatgaccagctgttcgtgttctatgatcatgagwgtcgccgtgtggagccccgaactccatgggtttccagtagaatttcaagccagatgtggctgcagctgagtcagagtctgaaagggtgggatcacatgtt

SEQ ID NO: 4873 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgcctttgggctacgtggatgaccagctgttcgtgttctatgatc

SEQ ID NO: 4874 - DNA, 201 bp, Homo sapiens; identical to SEQ ID NO: 4766

SEQ ID NO: 4875 - DNA, 201 bp, Homo sapiens; identical to SEQ ID NO: 4767

SEQ ID NO: 4876 - DNA, 201 bp, Homo sapiens; identical to SEQ ID NO: 4768

SEQ ID NO: 4877 - DNA, 201 bp, Homo sapiens; identical to SEQ ID NO: 4774

SEQ ID NO: 4878 - DNA, 201 bp, Homo sapiens; identical to SEQ ID NO: 4775

SEQ ID NO: 4879 - DNA, 201 bp, Homo sapiens; identical to SEQ ID NO: 4776

SEQ ID NO: 4880 - DNA, 201 bp, Homo sapiens; identical to SEQ ID NO: 4782

SEQ ID NO: 4881 - DNA, 201 bp, Homo sapiens; identical to SEQ ID NO: 4785

SEQ ID NO: 4882 - DNA, 201 bp, Homo sapiens; identical to SEQ ID NO: 4799

SEQ ID NO: 4883 - DNA, 201 bp, Homo sapiens; identical to SEQ ID NO: 4786

SEQ ID NO: 4884 - DNA, 201 bp, Homo sapiens; identical to SEQ ID NO: 4766

SEQ ID NO: 4885 - DNA, 201 bp, Homo sapiens; identical to SEQ ID NO: 4767

SEQ ID NO: 4886 - DNA, 201 bp, Homo sapiens; identical to SEQ ID NO: 4768

SEQ ID NO: 4887 - DNA, 201 bp, Homo sapiens
actgttgacttctggactattatggaaaatcacaaccacagcaaggtgcctcctttggtgaaggtgacacatcatgtgacctcttcagtgaccactctacrgtgtcgggccttgaactactacccccagaacatcaccatgaagtggctgaaggataagcagccaatggatgccaaggagttcgaacctaaagacgtattg

SEQ ID NO: 4888 - DNA, 201 bp, Homo sapiens; identical to SEQ ID NO: 4762

SEQ ID NO: 4889 - DNA, 201 bp, Homo sapiens; identical to SEQ ID NO: 4771

SEQ ID NO: 4890 - DNA, 201 bp, Homo sapiens; identical to SEQ ID NO: 4772

SEQ ID NO: 4891 - DNA, 201 bp, Homo sapiens; identical to SEQ ID NO: 4773

SEQ ID NO: 4892 - DNA, 201 bp, Homo sapiens; identical to SEQ ID NO: 4774

SEQ ID NO: 4893 - DNA, 201 bp, Homo sapiens; identical to SEQ ID NO: 4775

SEQ ID NO: 4894 - DNA, 201 bp, Homo sapiens; identical to SEQ ID NO: 4776

SEQ ID NO: 4895 - DNA, 201 bp, Homo sapiens; identical to SEQ ID NO: 4760

SEQ ID NO: 4896 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgcctcctttggtgaaggtgacacatcatgtgacctc

SEQ ID NO: 4897 - DNA, 201 bp, Homo sapiens
aaagggtgggatcacatgttcactgttgacttctggactattatggaaaatcacaaccacagcaaggtgcctcctttggtgaaggtgacacatcatgtgayctcttcagtgaccactctacggtgtcgggccttgaactactacccccagaacatcaccatgaagtggctgaaggataagcagccaatggatgccaaggag

SEQ ID NO: 4898 - DNA, 201 bp, Homo sapiens; identical to SEQ ID NO: 4764

SEQ ID NO: 4899 - DNA, 201 bp, Homo sapiens; identical to SEQ ID NO: 4780

SEQ ID NO: 4900 - DNA, 201 bp, Homo sapiens; identical to SEQ ID NO: 4781

SEQ ID NO: 4901 - DNA, 201 bp, Homo sapiens; identical to SEQ ID NO: 4782

SEQ ID NO: 4902 - DNA, 201 bp, Homo sapiens; identical to SEQ ID NO: 4761

SEQ ID NO: 4903 - DNA, 201 bp, Homo sapiens; identical to SEQ ID NO: 4784

SEQ ID NO: 4904 - DNA, 201 bp, Homo sapiens; identical to SEQ ID NO: 4785

SEQ ID NO: 4905 - DNA, 201 bp, Homo sapiens; identical to SEQ ID NO: 4786

SEQ ID NO: 4906 - DNA, 201 bp, Homo sapiens; identical to SEQ ID NO: 4766

SEQ ID NO: 4907 - DNA, 201 bp, Homo sapiens; identical to SEQ ID NO: 4767

SEQ ID NO: 4908 - DNA, 201 bp, Homo sapiens; identical to SEQ ID NO: 4768

SEQ ID NO: 4909 - DNA, 201 bp, Homo sapiens; identical to SEQ ID NO: 4790

SEQ ID NO: 4910 - DNA, 201 bp, Homo sapiens
gtggctgaaggataagcagccaatggatgccaaggagttcgaacctaaagacgtattgcccaatggggatgggacctaccagggctggataaccttggctktaccccctgtgctgagattacaggtgtgagccaccctgcccagccgtcaaaagagtcttaatatatatatccagatggcatgtgtttactttatgttact

SEQ ID NO: 4911 - DNA, 201 bp, Homo sapiens; identical to SEQ ID NO: 4774

SEQ ID NO: 4912 - DNA, 201 bp, Homo sapiens; identical to SEQ ID NO: 4775

SEQ ID NO: 4913 - DNA, 112 bp, Homo sapiens
aagctgttatttaattagccagtgaaaaactattaacaacttgtctattacctgttagtattattgttgcattaaaaatgcatatactttaataaatgtayattgtattgta

SEQ ID NO: 4914 - DNA, 201 bp, Homo sapiens; identical to SEQ ID NO: 4776

SEQ ID NO: 4915 - DNA, 201 bp, Homo sapiens; identical to SEQ ID NO: 4799

SEQ ID NO: 4916 - DNA, 201 bp, Homo sapiens; identical to SEQ ID NO: 4800

SEQ ID NO: 4917 - DNA, 201 bp, Homo sapiens; identical to SEQ ID NO: 4801

SEQ ID NO: 4918 - DNA, 201 bp, Homo sapiens; identical to SEQ ID NO: 4802

SEQ ID NO: 4919 - DNA, 201 bp, Homo sapiens; identical to SEQ ID NO: 4782

SEQ ID NO: 4920 - DNA, 201 bp, Homo sapiens; identical to SEQ ID NO: 4785

SEQ ID NO: 4921 - DNA, 201 bp, Homo sapiens; identical to SEQ ID NO: 4786

SEQ ID NO: 4922 - DNA, 201 bp, Homo sapiens; identical to SEQ ID NO: 4811

SEQ ID NO: 4923 - DNA, 201 bp, Homo sapiens
cgagccaggccggcgcttctcctcctgatgcttttgcagaccgcggtcctgcaggggcgcttgctgctgcctcctttggtgaaggtgacacatcatgtgayctcttcagtgaccactctacggtgtcgggccttgaactactacccccagaacatcaccatgaagtggctgaaggataagcagccaatggatgccaaggag

SEQ ID NO: 4924 - DNA, 201 bp, Homo sapiens
ctcctgatgcttttgcagaccgcggtcctgcaggggcgcttgctgctgcctcctttggtgaaggtgacacatcatgtgacctcttcagtgaccactctacrgtgtcgggccttgaactactacccccagaacatcaccatgaagtggctgaaggataagcagccaatggatgccaaggagttcgaacctaaagacgtattg

SEQ ID NO: 4925 - DNA, 201 bp, Homo sapiens; identical to SEQ ID NO: 4762

SEQ ID NO: 4926 - DNA, 201 bp, Homo sapiens; identical to SEQ ID NO: 4771

SEQ ID NO: 4927 - DNA, 201 bp, Homo sapiens; identical to SEQ ID NO: 4764

SEQ ID NO: 4928 - DNA, 201 bp, Homo sapiens; identical to SEQ ID NO: 4772

SEQ ID NO: 4929 - DNA, 201 bp, Homo sapiens; identical to SEQ ID NO: 4780

SEQ ID NO: 4930 - DNA, 201 bp, Homo sapiens; identical to SEQ ID NO: 4773

SEQ ID NO: 4931 - DNA, 201 bp, Homo sapiens; identical to SEQ ID NO: 4781

SEQ ID NO: 4932 - DNA, 201 bp, Homo sapiens; identical to SEQ ID NO: 4760

SEQ ID NO: 4933 - DNA, 201 bp, Homo sapiens; identical to SEQ ID NO: 4761

SEQ ID NO: 4934 - DNA, 201 bp, Homo sapiens; identical to SEQ ID NO: 4784

SEQ ID NO: 4935 - DNA, 201 bp, Homo sapiens
ggtgacttctggagccatccccgtttccccgccccccaaaagaagcggagatttaacggggacgtgcggccagagctggggaaatgggcccgcgagccagsccggcgcttctcctcctgatgcttttgcagaccgcggtcctgcaggggcgcttgctgctgcctcctttggtgaaggtgacacatcatgtgacctcttcag

SEQ ID NO: 4936 - DNA, 201 bp, Homo sapiens; identical to SEQ ID NO: 4801

SEQ ID NO: 4937 - DNA, 201 bp, Homo sapiens
aggcagaacagggcctacctggagagggactgccctgcacagctgcagcagttgctggagctggggagaggtgttttggaccaacaagtgaccactctacrgtgtcgggccttgaactactacccccagaacatcaccatgaagtggctgaaggataagcagccaatggatgccaaggagttcgaacctaaagacgtattg

SEQ ID NO: 4938 - DNA, 201 bp, Homo sapiens; identical to SEQ ID NO: 4762

SEQ ID NO: 4939 - DNA, 201 bp, Homo sapiens; identical to SEQ ID NO: 4771

SEQ ID NO: 4940 - DNA, 201 bp, Homo sapiens; identical to SEQ ID NO: 4764

SEQ ID NO: 4941 - DNA, 201 bp, Homo sapiens; identical to SEQ ID NO: 4772

SEQ ID NO: 4942 - DNA, 201 bp, Homo sapiens; identical to SEQ ID NO: 4780

SEQ ID NO: 4943 - DNA, 201 bp, Homo sapiens; identical to SEQ ID NO: 4773

SEQ ID NO: 4944 - DNA, 201 bp, Homo sapiens; identical to SEQ ID NO: 4781

SEQ ID NO: 4945 - DNA, 201 bp, Homo sapiens; identical to SEQ ID NO: 4760

SEQ ID NO: 4946 - DNA, 201 bp, Homo sapiens; identical to SEQ ID NO: 4761

SEQ ID NO: 4947 - DNA, 201 bp, Homo sapiens; identical to SEQ ID NO: 4784

SEQ ID NO: 4948 - DNA, 201 bp, Homo sapiens; identical to SEQ ID NO: 4849

SEQ ID NO: 4949 - DNA, 201 bp, Homo sapiens; identical to SEQ ID NO: 4800

SEQ ID NO: 4950 - DNA, 201 bp, Homo sapiens; identical to SEQ ID NO: 4766

SEQ ID NO: 4951 - DNA, 201 bp, Homo sapiens; identical to SEQ ID NO: 4767

SEQ ID NO: 4952 - DNA, 201 bp, Homo sapiens; identical to SEQ ID NO: 4768

SEQ ID NO: 4953 - DNA, 201 bp, Homo sapiens; identical to SEQ ID NO: 4937

SEQ ID NO: 4954 - DNA, 201 bp, Homo sapiens; identical to SEQ ID NO: 4762

SEQ ID NO: 4955 - DNA, 201 bp, Homo sapiens; identical to SEQ ID NO: 4771

SEQ ID NO: 4956 - DNA, 201 bp, Homo sapiens; identical to SEQ ID NO: 4772

SEQ ID NO: 4957 - DNA, 201 bp, Homo sapiens; identical to SEQ ID NO: 4773

SEQ ID NO: 4958 - DNA, 201 bp, Homo sapiens; identical to SEQ ID NO: 4774

SEQ ID NO: 4959 - DNA, 201 bp, Homo sapiens; identical to SEQ ID NO: 4775

SEQ ID NO: 4960 - DNA, 201 bp, Homo sapiens; identical to SEQ ID NO: 4776

SEQ ID NO: 4961 - DNA, 201 bp, Homo sapiens; identical to SEQ ID NO: 4760

SEQ ID NO: 4962 - DNA, 201 bp, Homo sapiens; identical to SEQ ID NO: 4799

SEQ ID NO: 4963 - DNA, 201 bp, Homo sapiens; identical to SEQ ID NO: 4800

SEQ ID NO: 4964 - DNA, 201 bp, Homo sapiens; identical to SEQ ID NO: 4801

SEQ ID NO: 4965 - DNA, 201 bp, Homo sapiens; identical to SEQ ID NO: 4764

SEQ ID NO: 4966 - DNA, 201 bp, Homo sapiens; identical to SEQ ID NO: 4780

SEQ ID NO: 4967 - DNA, 201 bp, Homo sapiens; identical to SEQ ID NO: 4781

SEQ ID NO: 4968 - DNA, 201 bp, Homo sapiens; identical to SEQ ID NO: 4782

SEQ ID NO: 4969 - DNA, 201 bp, Homo sapiens; identical to SEQ ID NO: 4761

SEQ ID NO: 4970 - DNA, 201 bp, Homo sapiens; identical to SEQ ID NO: 4784

SEQ ID NO: 4971 - DNA, 201 bp, Homo sapiens; identical to SEQ ID NO: 4785

SEQ ID NO: 4972 - DNA, 201 bp, Homo sapiens; identical to SEQ ID NO: 4786

SEQ ID NO: 4973 - DNA, 201 bp, Homo sapiens
aaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgag

SEQ ID NO: 4974 - DNA, 201 bp, Homo sapiens
taagaagaaggatccaaagtgtatatttgcatgtgaagagatgtcaggagaagttcggtttagtagccatttacctcaaccaaatagcctttgtagtttartagtagaacccatggaaaactggctacagttgatgttgaattgggaccctcagcagagaggaggacctgttgaccttactttgaagcagccaagatgttt

SEQ ID NO: 4975 - DNA, 201 bp, Homo sapiens
aattccactgaaaatttaacagtatccccttctcatcgaagggattgtgtatctgtgcttctaatattagttggctttcataaatcatgttgttgtgtgtrtatgtatttaagatgtacatttaataatatcaaagagaagatgcctgttaatttataatgtatttgaaaattacatgttttttcatttgtaaaaatgagt

SEQ ID NO: 4976 - DNA, 201 bp, Homo sapiens
acaactgaaagctaaattggagttttttcacaaaagcattcagcttgacttggagagatacagcgagcagatgacgtatgggatatcttcagaaaaaatgytaaaagcatggaaagaaatggaagaaaaggccatccactatgctgaggttggtgtcattggatacctggaggatcagattatgtctttgcatgctgaaat

SEQ ID NO: 4977 - DNA, 201 bp, Homo sapiens
ctttgatctcagcatcacaacaactgaaagctaaattggagttttttcacaaaagcattcagcttgacttggagagatacagcgagcagatgacgtatggratatcttcagaaaaaatgctaaaagcatggaaagaaatggaagaaaaggccatccactatgctgaggttggtgtcattggatacctggaggatcagatta

SEQ ID NO: 4978 - DNA, 201 bp, Homo sapiens
aatactgttctggaggagatctccgaaagctgctcaacaaaccagaaaattgttgtggacttaaagaaagccagatactttctttactaagtgatataggrtctgggattcgatatttgcatgaaaacaaaattatacatcgagatctaaaacctgaaaacatagttcttcaggatgttggtggaaagataatacataaaa

SEQ ID NO: 4979 - DNA, 201 bp, Homo sapiens
tcattttaaattccactgaaaatttaacagtatccccttctcatcgaagggattgtgtatctgtgcttctaatattagttggctttcataaatcatgttgktgtgtgtatatgtatttaagatgtacatttaataatatcaaagagaagatgcctgttaatttataatgtatttgaaaattacatgttttttcatttgtaa

SEQ ID NO: 4980 - DNA, 201 bp, Homo sapiens
tgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggttt

SEQ ID NO: 4981 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgttaagtcttcttagatataatgctaacttaacaaaaatgaagaacactttgatctcagcatcacaacaactgaaagctaaattgg

SEQ ID NO: 4982 - DNA, 201 bp, Homo sapiens
tcctggcatcataaggagttggtgtaatcattttaaattccactgaaaatttaacagtatccccttctcatcgaagggattgtgtatctgtgcttctaatmttagttggctttcataaatcatgttgttgtgtgtatatgtatttaagatgtacatttaataatatcaaagagaagatgcctgttaatttataatgtattt

SEQ ID NO: 4983 - DNA, 201 bp, Homo sapiens
agaacaaggagctccggagcaagctccacgagatggagggggccgtcaagtccaagttcaagtccaccatcgcggcgctggaggccaagattgcacagctrgaggagcaggtcgagcaggaggccagagagaaacaggcggccaccaagtcgctgaagcagaaagacaagaagctgaaggaaatcttgctgcaggtggagg

SEQ ID NO: 4984 - DNA, 201 bp, Homo sapiens
tgaacaaagccctggacaagacccatcggcaaggggcttccttcctggggatcctggatatagctggatttgagatctttgaggtgaactccttcgagcarctgtgcatcaactacaccaacgagaagctgcagcagctcttcaaccacaccatgttcatcctggagcaggaggagtaccagcgcgagggcatcgagtgga

SEQ ID NO: 4985 - DNA, 201 bp, Homo sapiens
gaagtgacttgcttttggagggcttcaacaactacaccttcctctccaatggctttgtgcccatcccagcagcccaggatgatgagatgttccaggaaacygtggaggccatggcaatcatgggtttcagcgaggaggagcagctatccatattgaaggtggtatcatcggtcctgcagcttggaaatatcgtcttcaaga

SEQ ID NO: 4986 - DNA, 201 bp, Homo sapiens
agctgggcaagctgatgaccacgctacgcaacaccacgcccaacttcgtgcgctgcatcatccccaaccacgagaagaggtccggcaagctggatgcgttyctggtgctggagcagctgcggtgcaatggggtgctggaaggcattcgcatctgccggcagggcttccccaaccggatcgtcttccaggagttccgccaac

SEQ ID NO: 4987 - DNA, 201 bp, Homo sapiens
accgggtccgcaaagccacacagcaggccgagcagctcagcaacgagctggccacagagcgcagcacggcccagaagaatgagagtgcccggcagcagctygagcggcagaacaaggagctccggagcaagctccacgagatggagggggccgtcaagtccaagttcaagtccaccatcgcggcgctggaggccaagattg

SEQ ID NO: 4988 - DNA, 201 bp, Homo sapiens
agttcctctttgtggacaaaaacttcatcaacagcccagtggcccaggctgactgggccgccaagagactcgtctgggtcccctcggagaagcagggcttygaggcagccagcattaaggaggagaagggggatgaggtggttgtggagctggtggagaatggcaagaaggtcacggttgggaaagatgacatccagaaga

SEQ ID NO: 4989 - DNA, 201 bp, Homo sapiens
ccaaaacagtgaagaacgacaactcctcacgattcggcaaattcatccgcatcaacttcgacgtcacgggttacatcgtgggagccaacattgagacctayctgctagaaaaatcacgggcaattcgccaagccagagacgagaggacattccacatcttttactacatgattgctggagccaaggagaagatgagaagtg

SEQ ID NO: 4990 - DNA, 201 bp, Homo sapiens
tgagagcgtcacagggatgcttaacgaggccgaggggaaggccattaagctggccaaggacgtggcgtccctcagttcccagctccaggacacccaggagytgcttcaagaagaaacccggcagaagctcaacgtgtctacgaagctgcgccagctggaggaggagcggaacagcctgcaagaccagctggacgaggagat

SEQ ID NO: 4991 - DNA, 201 bp, Homo sapiens
ctggcctcttctgcgtggtggtcaacccctataaacacctgcccatctactcggagaagatcgtcgacatgtacaagggcaagaagaggcacgagatgccrcctcacatctacgccatcgcagacacggcctaccggagcatgcttcaagatcgggaggaccagtccattctatgcacaggcgagtctggagccgggaaaa

SEQ ID NO: 4992 - DNA, 201 bp, Homo sapiens
tgaggagaagaggaggcaactgcagagacagcttcacgagtatgagacggaactggaagacgagcgaaagcaacgtgccctggcagctgcagcaaagaagmagctggaaggggacctgaaagacctggagcttcaggccgactctgccatcaaggggagggaggaagccatcaagcagctacgcaaactgcaggctcagat

SEQ ID NO: 4993 - DNA, 201 bp, Homo sapiens
tgaggcagaagccagggagaaggaaaccaaggccctgtccctggctcgggcccttgaagaggccttggaagccaaagaggaactcgagcggaccaacaaartgctcaaagccgaaatggaagacctggtcagctccaaggatgacgtgggcaagaacgtccatgagctggagaagtccaagcgggccctggagacccagat

SEQ ID NO: 4994 - DNA, 141 bp, Homo sapiens
agagcaagctcaggcgaggaaacgagacctctttcgttccttctagaaggtctggaggacgtagagttattcaatggaaccaaggccagtgaataagcaabtttctacagttttgcaccacggcaagaaaaccaaaaacca

SEQ ID NO: 4995 - DNA, 201 bp, Homo sapiens
agaaaaggccaagaatcttaccaagctgaaaaacaagcatgaatctatgatttcagaactggaagtgcggctaaagaaggaagagaagagccgacaggagmtggagaagctgaaacggaagctggagggtgatgccagcgacttccacgagcagatcgctgacctccaggcgcagatcgcagagctcaagatgcagctggc

SEQ ID NO: 4996 - DNA, 201 bp, Homo sapiens
ggcagctgtacaaggagcagctgggcaagctgatgaccacgctacgcaacaccacgcccaacttcgtgcgctgcatcatccccaaccacgagaagaggtcyggcaagctggatgcgttcctggtgctggagcagctgcggtgcaatggggtgctggaaggcattcgcatctgccggcagggcttccccaaccggatcgtct

SEQ ID NO: 4997 - DNA, 201 bp, Homo sapiens
gaactggcagtggtggaggcttttcaccaaagtgaagccactgctgcaggtgacacggcaggaggaggagatgcaggccaaggaggatgaactgcagaagrccaaggagcggcagcagaaggcagagaatgagcttaaggagctggaacagaagcactcgcagctgaccgaggagaagaacctgctacaggaacagctgca

SEQ ID NO: 4998 - DNA, 201 bp, Homo sapiens
tggccttccaggcgatgtgtcgtggctacttggccagaaaggcttttgccaagaggcagcagcagctgaccgccatgaaggtgattcagaggaactgcgcygcctacctcaagctgcggaactggcagtggtggaggcttttcaccaaagtgaagccactgctgcaggtgacacggcaggaggaggagatgcaggccaagg

SEQ ID NO: 4999 - DNA, 201 bp, Homo sapiens
acacgcacaggcggtggaggagctcacagagcagcttgagcagttcaagagggccaaggcgaacctagacaagaataagcagacgctggagaaagagaacrcagacctggccggggagctgcgggtcctgggccaggccaagcaggaggtggaacataagaagaagaagctggaggcgcaggtgcaggagctgcagtccaa

SEQ ID NO: 5000 - DNA, 201 bp, Homo sapiens
ggagctcaatgacaaagtccacaagctgcagaatgaagttgagagcgtcacagggatgcttaacgaggccgaggggaaggccattaagctggccaaggacrtggcgtccctcagttcccagctccaggacacccaggagctgcttcaagaagaaacccggcagaagctcaacgtgtctacgaagctgcgccagctggagga

SEQ ID NO: 5001 - DNA, 201 bp, Homo sapiens
gatcgctgacctccaggcgcagatcgcagagctcaagatgcagctggccaagaaggaggaggagctgcaggcggccctggccaggcttgacgatgaaatcrctcagaagaacaatgccctgaagaagatccgggagctggagggccacatctcagacctccaggaggacctggactcagagcgggccgccaggaacaaggc

SEQ ID NO: 5002 - DNA, 201 bp, Homo sapiens
caggaggaggagatgcaggccaaggaggatgaactgcagaagaccaaggagcggcagcagaaggcagagaatgagcttaaggagctggaacagaagcactygcagctgaccgaggagaagaacctgctacaggaacagctgcaggcagagacagagctgtatgcagaggctgaggagatgcgggtgcggctggcggccaag

SEQ ID NO: 5003 - DNA, 201 bp, Homo sapiens
gggtgctggaaggcattcgcatctgccggcagggcttccccaaccggatcgtcttccaggagttccgccaacgctacgagatcctggcggcgaatgccatycccaaaggcttcatggacgggaagcaggcctgcattctcatgatcaaagccctggaacttgaccccaacttatacaggatagggcagagcaaaatcttct

SEQ ID NO: 5004 - DNA, 201 bp, Homo sapiens
ttgatttggacaaccagcggcaactcgtgtccaacctggaaaagaagcagaggaaatttgatcagttgttagccgaggagaaaaacatctcttccaaataygcggatgagagggacagagctgaggcagaagccagggagaaggaaaccaaggccctgtccctggctcgggcccttgaagaggccttggaagccaaagagg

SEQ ID NO: 5005 - DNA, 201 bp, Homo sapiens
ctttcgtggagaagctgtgcacggagcagggcagccaccccaagttccagaagcccaagcagctcaaggacaagactgagttctccatcatccattatgcygggaaggtggactataatgcgagtgcctggctgaccaagaatatggacccgctgaatgacaacgtgacttccctgctcaatgcctcctccgacaagtttg

SEQ ID NO: 5006 - DNA, 201 bp, Homo sapiens
aggactttgccagcaccgtggaagctctggaagaggggaagaagaggttccagaaggagatcgagaacctcacccagcagtacgaggagaaggcggccgcktatgataaactggaaaagaccaagaacaggcttcagcaggagctggacgacctggttgttgatttggacaaccagcggcaactcgtgtccaacctggaaa

SEQ ID NO: 5007 - DNA, 201 bp, Homo sapiens
gggagcggtacttctcagggctaatatatacgtactctggcctcttctgcgtggtggtcaacccctataaacacctgcccatctactcggagaagatcgtygacatgtacaagggcaagaagaggcacgagatgccgcctcacatctacgccatcgcagacacggcctaccggagcatgcttcaagatcgggaggaccagt

SEQ ID NO: 5008 - DNA, 201 bp, Homo sapiens
cccagaagaatgagagtgcccggcagcagctcgagcggcagaacaaggagctccggagcaagctccacgagatggagggggccgtcaagtccaagttcaartccaccatcgcggcgctggaggccaagattgcacagctggaggagcaggtcgagcaggaggccagagagaaacaggcggccaccaagtcgctgaagcaga

SEQ ID NO: 5009 - DNA, 201 bp, Homo sapiens
ccacggaggacgccaaactgcggctggaagtcaacatgcaggcgctcaagggccagttcgaaagggatctccaagcccgggacgagcagaatgaggagaaraggaggcaactgcagagacagcttcacgagtatgagacggaactggaagacgagcgaaagcaacgtgccctggcagctgcagcaaagaagaagctggaag

SEQ ID NO: 5010 - DNA, 201 bp, Homo sapiens; identical to SEQ ID NO: 4983

SEQ ID NO: 5011 - DNA, 201 bp, Homo sapiens; identical to SEQ ID NO: 4984

SEQ ID NO: 5012 - DNA, 201 bp, Homo sapiens; identical to SEQ ID NO: 4985

SEQ ID NO: 5013 - DNA, 201 bp, Homo sapiens; identical to SEQ ID NO: 4986

SEQ ID NO: 5014 - DNA, 201 bp, Homo sapiens; identical to SEQ ID NO: 4987

SEQ ID NO: 5015 - DNA, 201 bp, Homo sapiens; identical to SEQ ID NO: 4988

SEQ ID NO: 5016 - DNA, 201 bp, Homo sapiens; identical to SEQ ID NO: 4989

SEQ ID NO: 5017 - DNA, 201 bp, Homo sapiens; identical to SEQ ID NO: 4990

SEQ ID NO: 5018 - DNA, 201 bp, Homo sapiens; identical to SEQ ID NO: 4991

SEQ ID NO: 5019 - DNA, 201 bp, Homo sapiens; identical to SEQ ID NO: 4992

SEQ ID NO: 5020 - DNA, 201 bp, Homo sapiens; identical to SEQ ID NO: 4993

SEQ ID NO: 5021 - DNA, 201 bp, Homo sapiens
tctggaggacgtagagttattgaaaatgcagatggttctgaggaggaaacggacactcgagacgcagacttcaatggaaccaaggccagtgaataagcaabtttctacagttttgcaccacggcaagaaaaccaaaaaccaaaacaaacaaacaaaaaaaacccaacaacaacccagaacaaagctcccgggttcaagcga

SEQ ID NO: 5022 - DNA, 201 bp, Homo sapiens; identical to SEQ ID NO: 4995

SEQ ID NO: 5023 - DNA, 201 bp, Homo sapiens; identical to SEQ ID NO: 4996

SEQ ID NO: 5024 - DNA, 201 bp, Homo sapiens; identical to SEQ ID NO: 4997

SEQ ID NO: 5025 - DNA, 201 bp, Homo sapiens; identical to SEQ ID NO: 4998

SEQ ID NO: 5026 - DNA, 201 bp, Homo sapiens; identical to SEQ ID NO: 4999

SEQ ID NO: 5027 - DNA, 201 bp, Homo sapiens; identical to SEQ ID NO: 5000

SEQ ID NO: 5028 - DNA, 201 bp, Homo sapiens; identical to SEQ ID NO: 5001

SEQ ID NO: 5029 - DNA, 201 bp, Homo sapiens; identical to SEQ ID NO: 5002

SEQ ID NO: 5030 - DNA, 201 bp, Homo sapiens; identical to SEQ ID NO: 5003

SEQ ID NO: 5031 - DNA, 201 bp, Homo sapiens; identical to SEQ ID NO: 5004

SEQ ID NO: 5032 - DNA, 201 bp, Homo sapiens; identical to SEQ ID NO: 5005

SEQ ID NO: 5033 - DNA, 201 bp, Homo sapiens; identical to SEQ ID NO: 5006

SEQ ID NO: 5034 - DNA, 201 bp, Homo sapiens; identical to SEQ ID NO: 5007

SEQ ID NO: 5035 - DNA, 201 bp, Homo sapiens; identical to SEQ ID NO: 5008

SEQ ID NO: 5036 - DNA, 201 bp, Homo sapiens; identical to SEQ ID NO: 5009

SEQ ID NO: 5037 - DNA, 201 bp, Homo sapiens; identical to SEQ ID NO: 4983

SEQ ID NO: 5038 - DNA, 201 bp, Homo sapiens; identical to SEQ ID NO: 4984

SEQ ID NO: 5039 - DNA, 201 bp, Homo sapiens; identical to SEQ ID NO: 4985

SEQ ID NO: 5040 - DNA, 201 bp, Homo sapiens; identical to SEQ ID NO: 4986

SEQ ID NO: 5041 - DNA, 201 bp, Homo sapiens; identical to SEQ ID NO: 4987

SEQ ID NO: 5042 - DNA, 201 bp, Homo sapiens; identical to SEQ ID NO: 4988

SEQ ID NO: 5043 - DNA, 201 bp, Homo sapiens; identical to SEQ ID NO: 4989

SEQ ID NO: 5044 - DNA, 201 bp, Homo sapiens; identical to SEQ ID NO: 4990

SEQ ID NO: 5045 - DNA, 201 bp, Homo sapiens; identical to SEQ ID NO: 4991

SEQ ID NO: 5046 - DNA, 201 bp, Homo sapiens; identical to SEQ ID NO: 4992

SEQ ID NO: 5047 - DNA, 201 bp, Homo sapiens; identical to SEQ ID NO: 4993

SEQ ID NO: 5048 - DNA, 201 bp, Homo sapiens
tctggaggacgtagagttattgaaaatgcagatggttctgaggaggaaacggacactcgagacgcagacttcaatggaaccaaggccagtgaataagcaabtttctacagttttgcaccacggcaagaaaaccaaaaaccaaaacaaacaaacaaaaaaaacccaacaacaacccagaacaaagcaaaacccagcagactg

SEQ ID NO: 5049 - DNA, 201 bp, Homo sapiens
taaaacctcatctatacaagaatttaaaaataagctgggcgtggtggtacacacctgtggtcccagctactagggaggctgagccaggaagaacgctccarcccaggacttcgaggctgcaatgagctataattgcatcattgcactccagcctgggcaacagagaccctgtctcaaccaccaccaccaccaccaccccta

SEQ ID NO: 5050 - DNA, 201 bp, Homo sapiens; identical to SEQ ID NO: 4995

SEQ ID NO: 5051 - DNA, 201 bp, Homo sapiens; identical to SEQ ID NO: 4996

SEQ ID NO: 5052 - DNA, 201 bp, Homo sapiens
ggctgcaatgagctataattgcatcattgcactccagcctgggcaacagagaccctgtctcaaccaccaccaccaccaccacccctactacccctgtattsaaggtaaaaattgaagtttgtatgatgtaagagatgagaaaaacccaacaggaaacacagacacatcctccagttctatcaatggattgtgcagacactg

SEQ ID NO: 5053 - DNA, 201 bp, Homo sapiens; identical to SEQ ID NO: 4997

SEQ ID NO: 5054 - DNA, 201 bp, Homo sapiens; identical to SEQ ID NO: 4998

SEQ ID NO: 5055 - DNA, 201 bp, Homo sapiens
aacctttccaacttctcacgtcaggcctttgagaattctttccccctctcctggtttccacacctcagacacgcacagttcaccaagtgccttctgtagtyacatgaattgaaaaggagacgctgctcccacggaggggagcaggaatgctgcactgtttacaccctgactgtgcttaaaaacactttcactaataaatgg

SEQ ID NO: 5056 - DNA, 201 bp, Homo sapiens; identical to SEQ ID NO: 4999

SEQ ID NO: 5057 - DNA, 201 bp, Homo sapiens; identical to SEQ ID NO: 5000

SEQ ID NO: 5058 - DNA, 201 bp, Homo sapiens; identical to SEQ ID NO: 5001

SEQ ID NO: 5059 - DNA, 201 bp, Homo sapiens; identical to SEQ ID NO: 5002

SEQ ID NO: 5060 - DNA, 201 bp, Homo sapiens; identical to SEQ ID NO: 5003

SEQ ID NO: 5061 - DNA, 201 bp, Homo sapiens; identical to SEQ ID NO: 5004

SEQ ID NO: 5062 - DNA, 201 bp, Homo sapiens; identical to SEQ ID NO: 5005

SEQ ID NO: 5063 - DNA, 201 bp, Homo sapiens; identical to SEQ ID NO: 5006

SEQ ID NO: 5064 - DNA, 201 bp, Homo sapiens; identical to SEQ ID NO: 5007

SEQ ID NO: 5065 - DNA, 201 bp, Homo sapiens; identical to SEQ ID NO: 5008

SEQ ID NO: 5066 - DNA, 201 bp, Homo sapiens; identical to SEQ ID NO: 5009

SEQ ID NO: 5067 - DNA, 201 bp, Homo sapiens; identical to SEQ ID NO: 4983

SEQ ID NO: 5068 - DNA, 201 bp, Homo sapiens; identical to SEQ ID NO: 4984

SEQ ID NO: 5069 - DNA, 201 bp, Homo sapiens; identical to SEQ ID NO: 4985

SEQ ID NO: 5070 - DNA, 201 bp, Homo sapiens; identical to SEQ ID NO: 4986

SEQ ID NO: 5071 - DNA, 201 bp, Homo sapiens; identical to SEQ ID NO: 4987

SEQ ID NO: 5072 - DNA, 201 bp, Homo sapiens; identical to SEQ ID NO: 4988

SEQ ID NO: 5073 - DNA, 201 bp, Homo sapiens; identical to SEQ ID NO: 4989

SEQ ID NO: 5074 - DNA, 201 bp, Homo sapiens; identical to SEQ ID NO: 4990

SEQ ID NO: 5075 - DNA, 201 bp, Homo sapiens; identical to SEQ ID NO: 4991

SEQ ID NO: 5076 - DNA, 201 bp, Homo sapiens; identical to SEQ ID NO: 4992

SEQ ID NO: 5077 - DNA, 201 bp, Homo sapiens; identical to SEQ ID NO: 4993

SEQ ID NO: 5078 - DNA, 201 bp, Homo sapiens; identical to SEQ ID NO: 5021

SEQ ID NO: 5079 - DNA, 201 bp, Homo sapiens; identical to SEQ ID NO: 4995

SEQ ID NO: 5080 - DNA, 201 bp, Homo sapiens; identical to SEQ ID NO: 4996

SEQ ID NO: 5081 - DNA, 201 bp, Homo sapiens; identical to SEQ ID NO: 4997

SEQ ID NO: 5082 - DNA, 201 bp, Homo sapiens; identical to SEQ ID NO: 4998

SEQ ID NO: 5083 - DNA, 201 bp, Homo sapiens; identical to SEQ ID NO: 4999

SEQ ID NO: 5084 - DNA, 201 bp, Homo sapiens; identical to SEQ ID NO: 5000

SEQ ID NO: 5085 - DNA, 201 bp, Homo sapiens; identical to SEQ ID NO: 5001

SEQ ID NO: 5086 - DNA, 201 bp, Homo sapiens; identical to SEQ ID NO: 5002

SEQ ID NO: 5087 - DNA, 201 bp, Homo sapiens; identical to SEQ ID NO: 5004

SEQ ID NO: 5088 - DNA, 201 bp, Homo sapiens; identical to SEQ ID NO: 5003

SEQ ID NO: 5089 - DNA, 201 bp, Homo sapiens; identical to SEQ ID NO: 5005

SEQ ID NO: 5090 - DNA, 201 bp, Homo sapiens; identical to SEQ ID NO: 5006

SEQ ID NO: 5091 - DNA, 201 bp, Homo sapiens; identical to SEQ ID NO: 5007

SEQ ID NO: 5092 - DNA, 201 bp, Homo sapiens; identical to SEQ ID NO: 5008

SEQ ID NO: 5093 - DNA, 201 bp, Homo sapiens; identical to SEQ ID NO: 5009

SEQ ID NO: 5094 - DNA, 201 bp, Homo sapiens; identical to SEQ ID NO: 4983

SEQ ID NO: 5095 - DNA, 201 bp, Homo sapiens; identical to SEQ ID NO: 4984

SEQ ID NO: 5096 - DNA, 201 bp, Homo sapiens; identical to SEQ ID NO: 4985

SEQ ID NO: 5097 - DNA, 201 bp, Homo sapiens; identical to SEQ ID NO: 4986

SEQ ID NO: 5098 - DNA, 201 bp, Homo sapiens; identical to SEQ ID NO: 4987

SEQ ID NO: 5099 - DNA, 201 bp, Homo sapiens; identical to SEQ ID NO: 4988

SEQ ID NO: 5100 - DNA, 201 bp, Homo sapiens; identical to SEQ ID NO: 4989

SEQ ID NO: 5101 - DNA, 201 bp, Homo sapiens; identical to SEQ ID NO: 4990

SEQ ID NO: 5102 - DNA, 201 bp, Homo sapiens; identical to SEQ ID NO: 4991

SEQ ID NO: 5103 - DNA, 201 bp, Homo sapiens; identical to SEQ ID NO: 4992

SEQ ID NO: 5104 - DNA, 201 bp, Homo sapiens; identical to SEQ ID NO: 4993

SEQ ID NO: 5105 - DNA, 201 bp, Homo sapiens; identical to SEQ ID NO: 5021

SEQ ID NO: 5106 - DNA, 201 bp, Homo sapiens; identical to SEQ ID NO: 4995

SEQ ID NO: 5107 - DNA, 201 bp, Homo sapiens; identical to SEQ ID NO: 4996

SEQ ID NO: 5108 - DNA, 201 bp, Homo sapiens; identical to SEQ ID NO: 4997

SEQ ID NO: 5109 - DNA, 201 bp, Homo sapiens; identical to SEQ ID NO: 4998

SEQ ID NO: 5110 - DNA, 201 bp, Homo sapiens; identical to SEQ ID NO: 4999

SEQ ID NO: 5111 - DNA, 201 bp, Homo sapiens; identical to SEQ ID NO: 5000

SEQ ID NO: 5112 - DNA, 201 bp, Homo sapiens; identical to SEQ ID NO: 5001

SEQ ID NO: 5113 - DNA, 201 bp, Homo sapiens; identical to SEQ ID NO: 5002

SEQ ID NO: 5114 - DNA, 201 bp, Homo sapiens; identical to SEQ ID NO: 5003

SEQ ID NO: 5115 - DNA, 201 bp, Homo sapiens; identical to SEQ ID NO: 5004

SEQ ID NO: 5116 - DNA, 201 bp, Homo sapiens; identical to SEQ ID NO: 5005

SEQ ID NO: 5117 - DNA, 201 bp, Homo sapiens; identical to SEQ ID NO: 5006

SEQ ID NO: 5118 - DNA, 201 bp, Homo sapiens; identical to SEQ ID NO: 5007

SEQ ID NO: 5119 - DNA, 201 bp, Homo sapiens; identical to SEQ ID NO: 5008

SEQ ID NO: 5120 - DNA, 201 bp, Homo sapiens; identical to SEQ ID NO: 5009

SEQ ID NO: 5121 - DNA, 201 bp, Homo sapiens; identical to SEQ ID NO: 4984

SEQ ID NO: 5122 - DNA, 201 bp, Homo sapiens; identical to SEQ ID NO: 4985

SEQ ID NO: 5123 - DNA, 201 bp, Homo sapiens; identical to SEQ ID NO: 4986

SEQ ID NO: 5124 - DNA, 201 bp, Homo sapiens; identical to SEQ ID NO: 4988

SEQ ID NO: 5125 - DNA, 201 bp, Homo sapiens; identical to SEQ ID NO: 4989

SEQ ID NO: 5126 - DNA, 201 bp, Homo sapiens; identical to SEQ ID NO: 4991

SEQ ID NO: 5127 - DNA, 201 bp, Homo sapiens; identical to SEQ ID NO: 4995

SEQ ID NO: 5128 - DNA, 201 bp, Homo sapiens; identical to SEQ ID NO: 4996

SEQ ID NO: 5129 - DNA, 201 bp, Homo sapiens; identical to SEQ ID NO: 4997

SEQ ID NO: 5130 - DNA, 201 bp, Homo sapiens; identical to SEQ ID NO: 5055

SEQ ID NO: 5131 - DNA, 201 bp, Homo sapiens; identical to SEQ ID NO: 4998

SEQ ID NO: 5132 - DNA, 201 bp, Homo sapiens
acacgcacaggcggtggaggagctcacagagcagcttgagcagttcaagagggccaaggcgaacctagacaagaataagcagacgctggagaaagagaacrcagacctggccggggagctgcgggtcctgggccaggccaagcaggaggtggaacataagaagaagaagctggaggcgcaggtgcagacactgagttttta

SEQ ID NO: 5133 - DNA, 201 bp, Homo sapiens; identical to SEQ ID NO: 5001

SEQ ID NO: 5134 - DNA, 201 bp, Homo sapiens; identical to SEQ ID NO: 5002

SEQ ID NO: 5135 - DNA, 201 bp, Homo sapiens; identical to SEQ ID NO: 5003

SEQ ID NO: 5136 - DNA, 201 bp, Homo sapiens; identical to SEQ ID NO: 5005

SEQ ID NO: 5137 - DNA, 201 bp, Homo sapiens; identical to SEQ ID NO: 5007

SEQ ID NO: 5138 - DNA, 201 bp, Homo sapiens; identical to SEQ ID NO: 4983

SEQ ID NO: 5139 - DNA, 201 bp, Homo sapiens; identical to SEQ ID NO: 4984

SEQ ID NO: 5140 - DNA, 201 bp, Homo sapiens; identical to SEQ ID NO: 4985

SEQ ID NO: 5141 - DNA, 201 bp, Homo sapiens; identical to SEQ ID NO: 4986

SEQ ID NO: 5142 - DNA, 201 bp, Homo sapiens; identical to SEQ ID NO: 4987

SEQ ID NO: 5143 - DNA, 201 bp, Homo sapiens; identical to SEQ ID NO: 4988

SEQ ID NO: 5144 - DNA, 201 bp, Homo sapiens; identical to SEQ ID NO: 4989

SEQ ID NO: 5145 - DNA, 201 bp, Homo sapiens; identical to SEQ ID NO: 4990

SEQ ID NO: 5146 - DNA, 201 bp, Homo sapiens; identical to SEQ ID NO: 4991

SEQ ID NO: 5147 - DNA, 201 bp, Homo sapiens; identical to SEQ ID NO: 4992

SEQ ID NO: 5148 - DNA, 201 bp, Homo sapiens; identical to SEQ ID NO: 4993

SEQ ID NO: 5149 - DNA, 201 bp, Homo sapiens; identical to SEQ ID NO: 5048

SEQ ID NO: 5150 - DNA, 201 bp, Homo sapiens; identical to SEQ ID NO: 5049

SEQ ID NO: 5151 - DNA, 201 bp, Homo sapiens; identical to SEQ ID NO: 4995

SEQ ID NO: 5152 - DNA, 201 bp, Homo sapiens; identical to SEQ ID NO: 4996

SEQ ID NO: 5153 - DNA, 201 bp, Homo sapiens; identical to SEQ ID NO: 5052

SEQ ID NO: 5154 - DNA, 201 bp, Homo sapiens; identical to SEQ ID NO: 4997

SEQ ID NO: 5155 - DNA, 201 bp, Homo sapiens; identical to SEQ ID NO: 4998

SEQ ID NO: 5156 - DNA, 201 bp, Homo sapiens; identical to SEQ ID NO: 5055

SEQ ID NO: 5157 - DNA, 201 bp, Homo sapiens; identical to SEQ ID NO: 4999

SEQ ID NO: 5158 - DNA, 201 bp, Homo sapiens; identical to SEQ ID NO: 5000

SEQ ID NO: 5159 - DNA, 201 bp, Homo sapiens; identical to SEQ ID NO: 5001

SEQ ID NO: 5160 - DNA, 201 bp, Homo sapiens; identical to SEQ ID NO: 5002

SEQ ID NO: 5161 - DNA, 201 bp, Homo sapiens; identical to SEQ ID NO: 5003

SEQ ID NO: 5162 - DNA, 201 bp, Homo sapiens; identical to SEQ ID NO: 5004

SEQ ID NO: 5163 - DNA, 201 bp, Homo sapiens; identical to SEQ ID NO: 5005

SEQ ID NO: 5164 - DNA, 201 bp, Homo sapiens; identical to SEQ ID NO: 5006

SEQ ID NO: 5165 - DNA, 201 bp, Homo sapiens; identical to SEQ ID NO: 5007

SEQ ID NO: 5166 - DNA, 201 bp, Homo sapiens; identical to SEQ ID NO: 5008

SEQ ID NO: 5167 - DNA, 201 bp, Homo sapiens; identical to SEQ ID NO: 5009

SEQ ID NO: 5168 - DNA, 201 bp, Homo sapiens
atggagatattcatcgaggttttcagtcacttcttgttgcaattaacagaactgacactgaatatgtgcttagaactgccaacgggctctttggagaaaartcttatgatttcctcacaggttttacagattcctgtggcaaattctaccaagcaacgataaaacagctagactttgtgaatgatacagagaagtccacaa

SEQ ID NO: 5169 - DNA, 201 bp, Homo sapiens
attaaagctggaggagagttatgacttggagcctttccttcgaagattaggaatgatcgatgcttttgacgaagccaaggcagacttttctggaatgtcarctgagaagaatgtgcctctgtccaaggttgcccacaagtgcttcgtggaggtcaatgaggaaggcacagaggctgccgcagccactgctgtggtcaggaa

SEQ ID NO: 5170 - DNA, 201 bp, Homo sapiens
gcagcaggagaccttctctgatggatgacctctgtgaagcaaatggcacttttgccatcagcttatttaaaatattgggggaagaggacaactcaagaaaygtattcttctctcccatgagcatctcctctgccctggccatggtcttcatgggggcaaagggaagcactgcagcccagatgtcccaggcactttgtttat

SEQ ID NO: 5171 - DNA, 201 bp, Homo sapiens
acagaggctgccgcagccactgctgtggtcaggaattcccggtgcagcagaatggagccaagattctgtgcagaccacccttttcttttcttcatcaggcrccacaaaaccaactgcatcttgttctgtggcaggttctcttctccgtaaagaggagcaattgctgtacataccctcctttccttctacctatcttgcctt

SEQ ID NO: 5172 - DNA, 201 bp, Homo sapiens
atctcctctgccctggccatggtcttcatgggggcaaagggaagcactgcagcccagatgtcccaggcactttgtttatacaaagacggagatattcaccraggtttccagtcacttctcagtgaagttaacagaactggcactcagtacttgcttagaactgccaacagactctttggagaaaagacgtgtgatttcctt

SEQ ID NO: 5173 - DNA, 201 bp, Homo sapiens
tttgacagaaagtacacaaggggaatgctctttaaaaccaacgaggaaaaaaagacagtgcagatgatgtttaaggaagctaagtttaaaatggggtatgyggatgaggtacacacccaggtcctggagctgccctatgtggaagaggagctgagcatggtcattctgcttcccgatgacaacacggacctcgccgtggtg

SEQ ID NO: 5174 - DNA, 201 bp, Homo sapiens
ctttccttcgaagattaggaatgatcgatgcttttgacgaagccaaggcagacttttctggaatgtcaactgagaagaatgtgcctctgtccaaggttgcycacaagtgcttcgtggaggtcaatgaggaaggcacagaggctgccgcagccactgctgtggtcaggaattcccggtgcagcagaatggagccaagattct

SEQ ID NO: 5175 - DNA, 201 bp, Homo sapiens
aagagtgcaggaagcatataaatgactgggtggcagagaagactgaaggtaagatttcagaggtactggatgctgggacagtcgatcccctgacaaagctrgtccttgtgaatgccatttatttcaagggaaagtggaatgagcaatttgacagaaagtacacaaggggaatgctctttaaaaccaacgaggaaaaaaaga

SEQ ID NO: 5176 - DNA, 201 bp, Homo sapiens
agaatgtgcctctgtccaaggttgcccacaagtgcttcgtggaggtcaatgaggaaggcacagaggctgccgcagccactgctgtggtcaggaattcccgrtgcagcagaatggagccaagattctgtgcagaccacccttttcttttcttcatcaggcaccacaaaaccaactgcatcttgttctgtggcaggttctctt

SEQ ID NO: 5177 - DNA, 201 bp, Homo sapiens
cactttaggactgagctaggaggcaaatatctgaagcttgctatgctgttctttccattccttttccctctgaaacacacaaaataccaaaggaacttacrcaacacaccactgagtcctctaactaatcatatgtgctcagacacagctcaagcacaccccttagttaagaaagaacctccatatacattaatttttttc

SEQ ID NO: 5178 - DNA, 201 bp, Homo sapiens
ctgaagagtgcaggaagcatataaatgactgggtggcagagaagactgaaggtaagatttcagaggtactggatgctgggacagtcgatcccctgacaaasctggtccttgtgaatgccatttatttcaagggaaagtggaatgagcaatttgacagaaagtacacaaggggaatgctctttaaaaccaacgaggaaaaaa

SEQ ID NO: 5179 - DNA, 201 bp, Homo sapiens
actgtgtggctggatttctataattgaatctaattttagacagtttgagtaattaaaattatttctattaacaaataatagattgctaataatatatattrtgctgttttggatatactaaatatttgctcacatccttaatatattttttaaaattcctaacaatagtactgttgagataaaagttgagcacattttgag

SEQ ID NO: 5180 - DNA, 201 bp, Homo sapiens; identical to SEQ ID NO: 5169

SEQ ID NO: 5181 - DNA, 201 bp, Homo sapiens
aaaactaaagaccttctctgatggatgacctctgtgaagcaaatggcacttttgccatcagcttatttaaaatattgggggaagaggacaactcaagaaaygtattcttctctcccatgagcatctcctctgccctggccatggtcttcatgggggcaaagggaagcactgcagcccagatgtcccaggcactttgtttat

SEQ ID NO: 5182 - DNA, 201 bp, Homo sapiens; identical to SEQ ID NO: 5168

SEQ ID NO: 5183 - DNA, 201 bp, Homo sapiens; identical to SEQ ID NO: 5171

SEQ ID NO: 5184 - DNA, 201 bp, Homo sapiens; identical to SEQ ID NO: 5172

SEQ ID NO: 5185 - DNA, 201 bp, Homo sapiens; identical to SEQ ID NO: 5173

SEQ ID NO: 5186 - DNA, 201 bp, Homo sapiens; identical to SEQ ID NO: 5174

SEQ ID NO: 5187 - DNA, 201 bp, Homo sapiens; identical to SEQ ID NO: 5175

SEQ ID NO: 5188 - DNA, 201 bp, Homo sapiens; identical to SEQ ID NO: 5176

SEQ ID NO: 5189 - DNA, 201 bp, Homo sapiens; identical to SEQ ID NO: 5177

SEQ ID NO: 5190 - DNA, 201 bp, Homo sapiens; identical to SEQ ID NO: 5178

SEQ ID NO: 5191 - DNA, 201 bp, Homo sapiens; identical to SEQ ID NO: 5179

SEQ ID NO: 5192 - DNA, 201 bp, Homo sapiens
tgtggaggctggacacacggccaccttgcgctgctcagccacaggcagccccgcgcccaccatccactggtccaagctgcgttccccactgccctggcagyaccggctggaaggtgacacactcatcataccccgggtagcccagcaggactcgggccagtacatctgcaatgccactagccctgctgggcacgctgaggc

SEQ ID NO: 5193 - DNA, 201 bp, Homo sapiens
cggcccgatgggcagccggccacacgcgagcacctcctgatggcactggccgacctggatgagctcctgatccgggccacgttctcctccgtgccgctggyggccagcatcagcgcagtcagcctggaggtcgcccagccggggccctcaaacagaccccgcgccctcgaggtggaggagtgccgctgcccgccaggctac

SEQ ID NO: 5194 - DNA, 201 bp, Homo sapiens
acagccaggtgccagggcccataggctgcaactgtgacccccaaggcagcgtcagcagccagtgtgatgctgctggtcagtgccagtgcaaggcccaggtrgaaggcctcacttgcagccactgccggccccaccacttccacctgagtgccagcaacccagacggctgcctgccctgcttctgtatgggcatcacccagc

SEQ ID NO: 5195 - DNA, 201 bp, Homo sapiens
tgtgctccacgtgcatgggggcggtgggcccagagtccaagtgagcccagagaggacccaggtccacgcaggccgcaccgtcaggctgtactgcagggctkcaggcgtgcctagcgccaccatcacctggaggaaggaagggggcagcctcccaccacaggcccggtcagagcgcacagacatcgcgacactgctcatccc

SEQ ID NO: 5196 - DNA, 201 bp, Homo sapiens
cgctgcagcgccacagggagccccacgcccaccctcgagtggacagggggccccggcggccagctccctgcgaaggcacaaatccacggcggcatcctgcrcctgccagctgtcgagcccacggatcaggcccagtacttgtgccgagcccacagcagcgctgggcagcaggtggccagggctgtgctccacgtgcatggg

SEQ ID NO: 5197 - DNA, 201 bp, Homo sapiens
agagcccagcactgatagggccccgcccaccgggccccgcccaccccaggccacatccccacccatctggaagtgaaggcccagggactcctccaacagamaacggacggacggatgccgctggtgctcaggaagagctagtgccttaggtgggggaaggcaggactcacgactgagagagagaggagggggatatgacca

SEQ ID NO: 5198 - DNA, 201 bp, Homo sapiens
tcctgatccgagcatcctacgcccagcagcccgctgagagcagggtctctggcatcagcatggacgtggctgtgcccgaggaaaccggccaggaccccgcrctggaagtggaacagtgctcctgcccacccgggtaccgtgggccgtcctgccaggactgtgacacaggctacacacgcacgcccagtggcctctacctgg

SEQ ID NO: 5199 - DNA, 201 bp, Homo sapiens
gaccccatcaatgacggcgagtggcaccgggtgacagcactgcgggagggccgcagaggttccatccaagtcgacggtgaggagctggtcagcggccggtscccaggtcccaacgtggcagtcaacgccaagggcagcgtctacatcggcggagcccctgacgtggccacgctgaccgggggcagattctcctcaggcatc

SEQ ID NO: 5200 - DNA, 201 bp, Homo sapiens
actgcgggagggccgcagaggttccatccaagtcgacggtgaggagctggtcagcggccggtccccaggtcccaacgtggcagtcaacgccaagggcagcrtctacatcggcggagcccctgacgtggccacgctgaccgggggcagattctcctcaggcatcacaggctgtgtcaagaacctggtgctgcactcggcccg

SEQ ID NO: 5201 - DNA, 201 bp, Homo sapiens
actcccgggccacgccccagcccgacaatgtcgagtatattattattaatattattatgaatttttgtaagaaaccgaggcgatgccacgctttgctgctmccgccctgggctggactggaggtgggcatgccaccctcacacacacagctgggcaaagccacaaggctggccagcaaggcaggttggatgggagtgggca

SEQ ID NO: 5202 - DNA, 201 bp, Homo sapiens
tggacgtggagttcaagccactcgcccctgacggggtcctgctgttcagcggggggaagagcgggcctgtggaggacttcgtgtccctggcgatggtgggyggccacctggagttccgctatgagttggggtcagggctggccgttctgcggagcgccgagccgctggccctgggccgctggcaccgtgtgtctgcagagc

SEQ ID NO: 5203 - DNA, 201 bp, Homo sapiens
tgtcagtgccggggagccccgctcctctgctcgttggacccggatcagcagcacccctgccaagttggagcagcggacatatgggctcatggacagccacrcggtgctgcagatttcatcagctaaaccatcagatgcgggcacttatgtgtgccttgctcagaatgcactaggcacagcacagaagcaggtggaggtgat

SEQ ID NO: 5204 - DNA, 201 bp, Homo sapiens
tgctggtcagtgccagtgcaaggcccaggtggaaggcctcacttgcagccactgccggccccaccacttccacctgagtgccagcaacccagacggctgcstgccctgcttctgtatgggcatcacccagcagtgcgccagctctgcctacacacgccacctgatctccacccactttgcccctggggacttccaaggctt

SEQ ID NO: 5205 - DNA, 201 bp, Homo sapiens
ggcagcgtctacatcggcggagcccctgacgtggccacgctgaccgggggcagattctcctcaggcatcacaggctgtgtcaagaacctggtgctgcactyggcccgacccggcgccccgcccccacagcccctggacctgcagcaccgcgcccaggccggggccaacacacgcccctgcccctcgtaggcacctgcctgc

SEQ ID NO: 5206 - DNA, 201 bp, Homo sapiens
tgaacccacagcgaaacagccgcctgacaggagaattcactgtggaacccgtgcccgagggtgcccagctctcttttggcaactttgcccaactcggccaygagtccttctactggcagctgccggagacataccagggagacaaggtggcggcctacggtgggaagttgcgatacaccctctcctacacagcaggcccac

SEQ ID NO: 5207 - DNA, 201 bp, Homo sapiens
tggcactggcaggcatcgacaccctcctgatccgagcatcctacgcccagcagcccgctgagagcagggtctctggcatcagcatggacgtggctgtgccygaggaaaccggccaggaccccgcgctggaagtggaacagtgctcctgcccacccgggtaccgtgggccgtcctgccaggactgtgacacaggctacacac

SEQ ID NO: 5208 - DNA, 201 bp, Homo sapiens
gccccacattctctctcctcgtggagacgacatctttaccgccccggccagagacaaccatcatgcgacagccaccagtcacccacgctcctcagcccctrcttcccggttccgtcaggcccctgccctgtgggccccaggaggccgcatgccgcaatgggcactgcatccccagagactacctctgcgacggacaggagg

SEQ ID NO: 5209 - DNA, 201 bp, Homo sapiens
cttcacagtcaccgtcccgcccagtgaggggtcttcctaccgccttaggagcccggtcatctccatcgacccgcccagcagcaccgtgcagcagggccagratgccagcttcaagtgcctcatccatgacggggcagcccccatcagcctcgagtggaagacccggaaccaggagctggaggacaacgtccacatcagtcc

SEQ ID NO: 5210 - DNA, 201 bp, Homo sapiens
gactcctccaacagacaacggacggacggatgccgctggtgctcaggaagagctagtgccttaggtgggggaaggcaggactcacgactgagagagagagragggggatatgaccaccctgccccatctgcaggagcctgaagatccagctcaagtgccatcctgccagtggcccccagactgtggggttgggacgcctgg

SEQ ID NO: 5211 - DNA, 201 bp, Homo sapiens
tggccacgctgaccgggggcagattctcctcaggcatcacaggctgtgtcaagaacctggtgctgcactcggcccgacccggcgccccgcccccacagccyctggacctgcagcaccgcgcccaggccggggccaacacacgcccctgcccctcgtaggcacctgcctgccccacacggactcccgggccacgccccagcc

SEQ ID NO: 5212 - DNA, 201 bp, Homo sapiens
tccctccctcaggggctgtaagggaaggcccaccccaactcttaccaggagctgctacaggcagagcccagcactgatagggccccgcccaccgggccccrcccaccccaggccacatccccacccatctggaagtgaaggcccagggactcctccaacagacaacggacggacggatgccgctggtgctcaggaagagct

SEQ ID NO: 5213 - DNA, 201 bp, Homo sapiens
aactggcggagttccgctgcagcgccacagggagccccacgcccaccctcgagtggacagggggccccggcggccagctccctgcgaaggcacaaatccayggcggcatcctgcgcctgccagctgtcgagcccacggatcaggcccagtacttgtgccgagcccacagcagcgctgggcagcaggtggccagggctgtgc

SEQ ID NO: 5214 - DNA, 201 bp, Homo sapiens
gttgtcctttcagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtgcacggctcccgtctgcggctcccccaggtc

SEQ ID NO: 5215 - DNA, 201 bp, Homo sapiens
gccggtccccaggtcccaacgtggcagtcaacgccaagggcagcgtctacatcggcggagcccctgacgtggccacgctgaccgggggcagattctcctcrggcatcacaggctgtgtcaagaacctggtgctgcactcggcccgacccggcgccccgcccccacagcccctggacctgcagcaccgcgcccaggccgggg

SEQ ID NO: 5216 - DNA, 201 bp, Homo sapiens
agcgtggaggcagcttacccagccggcaccagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacgtgcccagcgtctccccaccgatcaggatcgagt

SEQ ID NO: 5217 - DNA, 201 bp, Homo sapiens
tcaccatcgtgggcacccggcccagcaaccacggtacctaccgctgcgtggcctccaatgcctacggtgtggcccagagtgtggtgaacctcagtgtgcaygggccccctacagtgtccgtgctccccgagggccccgtgtgggtgaaagtgggaaaggctgtcaccctggagtgtgtcagtgccggggagccccgctcct

SEQ ID NO: 5218 - DNA, 201 bp, Homo sapiens
gcactgcgggagggccgcagaggttccatccaagtcgacggtgaggagctggtcagcggccggtccccaggtcccaacgtggcagtcaacgccaagggcarcgtctacatcggcggagcccctgacgtggccacgctgaccgggggcagattctcctcaggcatcacaggctgtgtcaagaacctggtgctgcactcggcc

SEQ ID NO: 5219 - DNA, 201 bp, Homo sapiens
gctcgtttttcagcacccccacccacctccacccagcccctggcacctcctctggcagactccccctcctaccacgtcctcctggcctgcattcccacccsctcctgccagcacacagcctggggtccctccctcaggggctgtaagggaaggcccaccccaactcttaccaggagctgctacaggcagagcccagcactg

SEQ ID NO: 5220 - DNA, 201 bp, Homo sapiens
caggaagagctagtgccttaggtgggggaaggcaggactcacgactgagagagagaggagggggatatgaccaccctgccccatctgcaggagcctgaagrtccagctcaagtgccatcctgccagtggcccccagactgtggggttgggacgcctggcctctgtgtcctagaagggaccctcctgtggtctttgtcttga

SEQ ID NO: 5221 - DNA, 201 bp, Homo sapiens
gtggtgcccgggcaggcccatgcccaggtcacgtggtacaagcgcgggggcagcctccccgcccggcaccagacccatggctcccagctgcggctccaccwcgtctcccctgccgactcaggcgagtatgtgtgtcgtgcagccagcggcccaggccctgagcaagaagcctccttcacagtcaccgtcccgcccagtgag

SEQ ID NO: 5222 - DNA, 201 bp, Homo sapiens
cccaccccaactcttaccaggagctgctacaggcagagcccagcactgatagggccccgcccaccgggccccgcccaccccaggccacatccccacccatytggaagtgaaggcccagggactcctccaacagacaacggacggacggatgccgctggtgctcaggaagagctagtgccttaggtgggggaaggcaggact

SEQ ID NO: 5223 - DNA, 201 bp, Homo sapiens
cgggggcagcctccccgcccggcaccagacccatggctcccagctgcggctccacctcgtctcccctgccgactcaggcgagtatgtgtgtcgtgcagccrgcggcccaggccctgagcaagaagcctccttcacagtcaccgtcccgcccagtgaggggtcttcctaccgccttaggagcccggtcatctccatcgaccc

SEQ ID NO: 5224 - DNA, 201 bp, Homo sapiens
agagcagcagctacgtgtgcgtctgcccagctggcttcaccgggagccgctgtgagcactcgcaggccctgcactgccatccagaggcctgtgggcccgaygccacctgtgtgaaccggcctgacggtcgaggctacacctgccgctgccacctgggccgctcggggttgcggtgtgaggaaggtgtgacagtgaccaccc

SEQ ID NO: 5225 - DNA, 201 bp, Homo sapiens
ctgagagcagcagctacgtgtgcgtctgcccagctggcttcaccgggagccgctgtgagcactcgcaggccctgcactgccatccagaggcctgtgggccsgacgccacctgtgtgaaccggcctgacggtcgaggctacacctgccgctgccacctgggccgctcggggttgcggtgtgaggaaggtgtgacagtgacca

SEQ ID NO: 5226 - DNA, 201 bp, Homo sapiens
cagccgatgggatgctgctgtacaatgggcagaagcgagtcccagggagccccaccaacctggccaaccggcagcccgacttcatctccttcggcctcgtkgggggaaggcccgagttccggttcgatgcaggctcaggcatggccaccatccgccatcccacaccactggccctgggccatttccacaccgtgaccctgc

SEQ ID NO: 5227 - DNA, 201 bp, Homo sapiens
tggagttcgaatgcctggcactgggtgaccccaagcctcaggtgacatggagcaaagttggagggcacctgcggccaggcattgtgcagagcggaggtgtygtcaggatcgcccacgtagagctggctgatgcgggacagtatcgctgcactgccaccaacgcagctggcaccacacaatcccacgtcctgctgcttgtgc

SEQ ID NO: 5228 - DNA, 201 bp, Homo sapiens
gggtggtgccctacttcacgcagaccccctactccttcctaccgctgcccaccatcaaggatgcctacaggaagttcgagatcaagatcaccttccggccygactcagccgatgggatgctgctgtacaatgggcagaagcgagtcccagggagccccaccaacctggccaaccggcagcccgacttcatctccttcggcc

SEQ ID NO: 5229 - DNA, 201 bp, Homo sapiens
gctctctccctgccacctccatcccagcagggtccacgcccaccgtgcaggtcacgcctcagctagagaccaagagcattggggccagcgttgagttccaytgtgctgtgcccagcgaccggggtacccagctccgttggttcaaggaagggggtcagctgcctccgggtcacagcgtgcaggatggggtgctccgaatcc

SEQ ID NO: 5230 - DNA, 201 bp, Homo sapiens
aaggccctcccggctctctccctgccacctccatcccagcagggtccacgcccaccgtgcaggtcacgcctcagctagagaccaagagcattggggccagygttgagttccactgtgctgtgcccagcgaccggggtacccagctccgttggttcaaggaagggggtcagctgcctccgggtcacagcgtgcaggatgggg

SEQ ID NO: 5231 - DNA, 201 bp, Homo sapiens
aaattcccggagaccaggttgtcagtgtggtgttcatcaaggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 5232 - DNA, 201 bp, Homo sapiens
tggtagacacgctggagtcggagtacttgaaaattcccggagaccaggttgtcagtgtggtgttcatcaaggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 5233 - DNA, 201 bp, Homo sapiens
aagccacaaggctggccagcaaggcaggttggatgggagtgggcacctcagaaagtcaccaggacttggggtcaggaacagtggctgggtgggcccagaastgcccccactgtccccctacccaccgatggagcccccagatagagctgggtggcctgtttctgcagcccttgggcagttctcactcctaggagagccaac

SEQ ID NO: 5234 - DNA, 201 bp, Homo sapiens
tgaggaccccatcaatgacggcgagtggcaccgggtgacagcactgcgggagggccgcagaggttccatccaagtcgacggtgaggagctggtcagcggcmggtccccaggtcccaacgtggcagtcaacgccaagggcagcgtctacatcggcggagcccctgacgtggccacgctgaccgggggcagattctcctcagg

SEQ ID NO: 5235 - DNA, 201 bp, Homo sapiens
gcagcggcccgatgggcagccagccacacgggagcacctgctgatggcactggcaggcatcgacaccctcctgatccgagcatcctacgcccagcagcccrctgagagcagggtctctggcatcagcatggacgtggctgtgcccgaggaaaccggccaggaccccgcgctggaagtggaacagtgctcctgcccacccgg

SEQ ID NO: 5236 - DNA, 201 bp, Homo sapiens
tctggaccctacttctggagcctcccttcacgcttcctgggggacaaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagccc

SEQ ID NO: 5237 - DNA, 201 bp, Homo sapiens
gtgcttctgcatgggtgtcagtcgccactgcaccagctcttcatggagccgtgcccagttgcatggggcctctgaggagcctggtcacttcagcctgaccmacgccgcaagcacccacaccaccaacgagggcatcttctcccccacgcccggggaactgggattctcctccttccacagactcttatctggaccctactt

SEQ ID NO: 5238 - DNA, 201 bp, Homo sapiens
ctcacttccgcggctgtgtgggcgaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggag

SEQ ID NO: 5239 - DNA, 201 bp, Homo sapiens
ccgccgactcgggcgagtacgtgtgccgagtgttgggcagctccgtgcctctagaggcctctgtcctggtcaccattgagcctgcgggctcagtgcctgcwcttggggtcacccccacggtccggatcgagtcatcgtcttcgcaagtggccgaggggcagaccctggacctgaactgcctcgttgctggtcaggcccatg

SEQ ID NO: 5240 - DNA, 201 bp, Homo sapiens
ggcagaccctggatctgaagtgcgtggtgcccgggcaggcccacgcccaggtcacgtggcacaagcgtggaggaaacctccctgcccggcaccaggtccayggcccactgctgaggctgaaccaggtgtccccggctgactctggcgagtactcgtgccaagtgaccggaagctcaggcaccctggaggcatctgtcctgg

SEQ ID NO: 5241 - DNA, 201 bp, Homo sapiens
gtctgcggctcccccaggtctcaccagctgattctggagaatatgtgtgccgtgtggagaatggatcgggccccaaggaggcctccattactgtgtctgtrctccacggcacccattctggccccagctacaccccagtgcccggcagcacccggcccatccgcatcgagccctcctcctcacacgtggcggaagggcaga

SEQ ID NO: 5242 - DNA, 201 bp, Homo sapiens
gccatcccacaccactggccctgggccatttccacaccgtgaccctgctgcgcagcctcacccagggctccctgattgtgggtgacctggccccggtcaaygggacctcccagggcaagttccagggcctggatctgaacgaggaactctacctgggtggctatcctgactatggtgccatccccaaggcggggctgagca

SEQ ID NO: 5243 - DNA, 201 bp, Homo sapiens
tcaggctaccccactcctgacatcagctggagcaagctggatggcagcctgccacctgacagccgcctggagaacaacatgctgatgctgccctcagtccraccccaggacgcaggtacctacgtctgcaccgccactaaccgccagggcaaggtcaaagcctttgcccacctgcaggtgccagagcgggtggtgccctac

SEQ ID NO: 5244 - DNA, 201 bp, Homo sapiens
gtccgtgtgcctgctggttctgcagctgtcttcccctgcatagcctcaggctaccccactcctgacatcagctggagcaagctggatggcagcctgccacytgacagccgcctggagaacaacatgctgatgctgccctcagtccgaccccaggacgcaggtacctacgtctgcaccgccactaaccgccagggcaaggtc

SEQ ID NO: 5245 - DNA, 174 bp, Homo sapiens
agagaggagggggatatgaccaccctgccccatctgcaggagcctgaagatccagctcaagtgccatcctgccagtggcccccagactgtggggttgggaygcctggcctctgtgtcctagaagggaccctcctgtggtctttgtcttgatttttcttaataaacggtgctatc

SEQ ID NO: 5246 - DNA, 201 bp, Homo sapiens
cctccctgcccggcaccagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggacccatcccacctgtcaggatcgagtcttcatcctccacagtggccga

SEQ ID NO: 5247 - DNA, 201 bp, Homo sapiens
cccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccagacccacggctcgctgctgcggctgcaccaggtgaccccggccgactcaggcgagtatgtgt

SEQ ID NO: 5248 - DNA, 201 bp, Homo sapiens
gggccagcaacggcatggaggcctccatcacggtcacagtaactgggacccagggggccaacttagcctaccctgccggcagcacccagcccatccgcatygagccctcctcctcgcaagtggcggaagggcagaccctggatctgaactgcgtggtgcccgggcagtcccatgcccaggtcacgtggcacaagcgtgggg

SEQ ID NO: 5249 - DNA, 201 bp, Homo sapiens
ggtgcccgggcaggcccatgcccaggtcacgtggtacaagcgcgggggcagcctccccgcccggcaccagacccatggctcccagctgcggctccacctcrtctcccctgccgactcaggcgagtatgtgtgtcgtgcagccagcggcccaggccctgagcaagaagcctccttcacagtcaccgtcccgcccagtgaggg

SEQ ID NO: 5250 - DNA, 201 bp, Homo sapiens
ccgctgcagcgccacagggagccccacgcccaccctcgagtggacagggggccccggcggccagctccctgcgaaggcacaaatccacggcggcatcctgygcctgccagctgtcgagcccacggatcaggcccagtacttgtgccgagcccacagcagcgctgggcagcaggtggccagggctgtgctccacgtgcatgg

SEQ ID NO: 5251 - DNA, 201 bp, Homo sapiens
ccgccccggccagagacaaccatcatgcgacagccaccagtcacccacgctcctcagcccctgcttcccggttccgtcaggcccctgccctgtgggccccrggaggccgcatgccgcaatgggcactgcatccccagagactacctctgcgacggacaggaggactgcgaggacggcagcgatgagctagactgtggcccc

SEQ ID NO: 5252 - DNA, 201 bp, Homo sapiens
agatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctgaattgccagcacaacacggaggggccacagtgcaacaagtgcaaggctggc

SEQ ID NO: 5253 - DNA, 201 bp, Homo sapiens
tgcccgggcagtcccatgcccaggtcacgtggcacaagcgtgggggcagcctccctgtccggcaccagacccacggctccctgctgagactctaccaagcrtcccccgccgactcgggcgagtacgtgtgccgagtgttgggcagctccgtgcctctagaggcctctgtcctggtcaccattgagcctgcgggctcagtgc

SEQ ID NO: 5254 - DNA, 201 bp, Homo sapiens
ccgagcccacagcagcgctgggcagcaggtggccagggctgtgctccacgtgcatgggggcggtgggcccagagtccaagtgagcccagagaggacccagrtccacgcaggccgcaccgtcaggctgtactgcagggctgcaggcgtgcctagcgccaccatcacctggaggaaggaagggggcagcctcccaccacaggc

SEQ ID NO: 5255 - DNA, 201 bp, Homo sapiens
ggcacaagcgcgggggcagcctcccggcccggcaccaggtgcatggctcgaggctacgcctgctccaggtgaccccagctgattcaggggagtacgtgtgycgtgtggtcggcagctcaggtacccaggaagcctcagtccttgtcaccatccagcagcgccttagtggctcccactcccagggtgtggcgtaccccgtcc

SEQ ID NO: 5256 - DNA, 201 bp, Homo sapiens
gatcacgggcaacaacatcatgctagtggcctcccagccagcgctgcagggccctgagaggaggagctacgagatcatgttccgagaggaattctggcgcyggcccgatgggcagccggccacacgcgagcacctcctgatggcactggccgacctggatgagctcctgatccgggccacgttctcctccgtgccgctggc

SEQ ID NO: 5257 - DNA, 201 bp, Homo sapiens
tgtgcagaccgtggtggttggccacgccgtggagttcgaatgcctggcactgggtgaccccaagcctcaggtgacatggagcaaagttggagggcacctgyggccaggcattgtgcagagcggaggtgtcgtcaggatcgcccacgtagagctggctgatgcgggacagtatcgctgcactgccaccaacgcagctggcac

SEQ ID NO: 5258 - DNA, 201 bp, Homo sapiens
ctccacccactttgcccctggggacttccaaggctttgccctggtgaacccacagcgaaacagccgcctgacaggagaattcactgtggaacccgtgcccragggtgcccagctctcttttggcaactttgcccaactcggccatgagtccttctactggcagctgccggagacataccagggagacaaggtggcggccta

SEQ ID NO: 5259 - DNA, 201 bp, Homo sapiens
atggccccaggggcccctcaggtccaagctgaagaagctgagctgactgtggaggctggacacacggccaccttgcgctgctcagccacaggcagccccgygcccaccatccactggtccaagctgcgttccccactgccctggcagcaccggctggaaggtgacacactcatcataccccgggtagcccagcaggactcg

SEQ ID NO: 5260 - DNA, 201 bp, Homo sapiens
acgagttggcccgtggcatgctggagccagtgcagcggccggacgtggtcctcgtgggtgccgggtaccgcctcctctcccgaggccacacacccacccamcctggtgctctgaaccagcgccaggtccagttctctgaggagcactgggtccatgagtctggccggccggtgcagcgcgcggagctgctgcaggtgctgc

SEQ ID NO: 5261 - DNA, 201 bp, Homo sapiens
gcagcggggacttccagatggtttatttccgagccctggtgaatttcactcgctccatcgagtacagccctcagctggaggatgcaggctccagagagttycgagaggtgtccgaggctgtggtagacacgctggagtcggagtacttgaaaattcccggagaccaggttgtcagtgtggtgttcatcaaggagctggatg

SEQ ID NO: 5262 - DNA, 201 bp, Homo sapiens
cccggatcagcagcacccctgccaagttggagcagcggacatatgggctcatggacagccacgcggtgctgcagatttcatcagctaaaccatcagatgcrggcacttatgtgtgccttgctcagaatgcactaggcacagcacagaagcaggtggaggtgatcgtggacacgggcgccatggccccaggggcccctcagg

SEQ ID NO: 5263 - DNA, 201 bp, Homo sapiens
cgcccctggctactatggcaaccccagccagggccagccatgccagagagacagccaggtgccagggcccataggctgcaactgtgacccccaaggcagcrtcagcagccagtgtgatgctgctggtcagtgccagtgcaaggcccaggtggaaggcctcacttgcagccactgccggccccaccacttccacctgagtgc

SEQ ID NO: 5264 - DNA, 201 bp, Homo sapiens
tccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcagatgccccattggct

SEQ ID NO: 5265 - DNA, 201 bp, Homo sapiens
caacaaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccaacctggtgctctgaaccagcgccaggtccagttctctgaggagcactgggtcca

SEQ ID NO: 5266 - DNA, 201 bp, Homo sapiens
cacggatggccaagccacatgtgacgcctgtgccccaggctacactggccgccgctgtgagagctgtgcccccggatacgagggcaaccccatccagcccrgcgggaagtgcaggcccgtcaaccaggagattgtgcgctgtgacgagcgtggcagcatggggacctccggggaggcctgccgctgtaagaacaatgtggt

SEQ ID NO: 5267 - DNA, 201 bp, Homo sapiens
accgccccggccagagacaaccatcatgcgacagccaccagtcacccacgctcctcagcccctgcttcccggttccgtcaggcccctgccctgtgggcccmaggaggccgcatgccgcaatgggcactgcatccccagagactacctctgcgacggacaggaggactgcgaggacggcagcgatgagctagactgtggccc

SEQ ID NO: 5268 - DNA, 201 bp, Homo sapiens
ctgaggacatagagaccgtcacagcaagccaaatgcgctggacacattcgtacctttctgatgatgaggacatgctggctgacagcatctcaggagacgamctgggcagtggggacctgggcagcggggacttccagatggtttatttccgagccctggtgaatttcactcgctccatcgagtacagccctcagctggagg

SEQ ID NO: 5269 - DNA, 201 bp, Homo sapiens
gctgcggctgcaccatgtgtccccggccgactcgggtgaatacgtgtgccgggtgatgggcagctctggccccctggaggcctcagtcctggtcaccatcraagcctctggctcaagtgctgtccacgtccccgccccaggtggagccccacccatccgcatcgagccctcctcctcccgagtggcagaagggcagaccct

SEQ ID NO: 5270 - DNA, 201 bp, Homo sapiens
cagctggagcaagctggatggcagcctgccacctgacagccgcctggagaacaacatgctgatgctgccctcagtccgaccccaggacgcaggtacctacrtctgcaccgccactaaccgccagggcaaggtcaaagcctttgcccacctgcaggtgccagagcgggtggtgccctacttcacgcagaccccctactcctt

SEQ ID NO: 5271 - DNA, 201 bp, Homo sapiens
ctgggtacctgtgaacgctgcagctgccatggccactcagaggcctgcgagccagaaacaggtgcctgccagggctgccagcatcacacggagggccctcrgtgtgagcagtgccagccaggatactacggggacgcccagcgggggacaccacaggactgccagctgtgcccctgctacggagaccctgctgccggccag

SEQ ID NO: 5272 - DNA, 201 bp, Homo sapiens
agggactcctccaacagacaacggacggacggatgccgctggtgctcaggaagagctagtgccttaggtgggggaaggcaggactcacgactgagagagasaggagggggatatgaccaccctgccccatctgcaggagcctgaagatccagctcaagtgccatcctgccagtggcccccagactgtggggttgggacgcc

SEQ ID NO: 5273 - DNA, 201 bp, Homo sapiens
tggagtatcgctgtgaccggcggcccgactgcagggacatgtctgatgagctcaattgtgaggagccagtcctgggtatcagccccacattctctctcctygtggagacgacatctttaccgccccggccagagacaaccatcatgcgacagccaccagtcacccacgctcctcagcccctgcttcccggttccgtcaggc

SEQ ID NO: 5274 - DNA, 201 bp, Homo sapiens
cgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtggactcctatggcggctccctgcgttacaacgtgcgctacgagttggcccgtggca

SEQ ID NO: 5275 - DNA, 201 bp, Homo sapiens
cacaagcgcgggggcagcctcccggcccggcaccaggtgcatggctcgaggctacgcctgctccaggtgaccccagctgattcaggggagtacgtgtgccrtgtggtcggcagctcaggtacccaggaagcctcagtccttgtcaccatccagcagcgccttagtggctcccactcccagggtgtggcgtaccccgtccgc

SEQ ID NO: 5276 - DNA, 201 bp, Homo sapiens
ccggcccggcaccaggtgcatggctcgaggctacgcctgctccaggtgaccccagctgattcaggggagtacgtgtgccgtgtggtcggcagctcaggtayccaggaagcctcagtccttgtcaccatccagcagcgccttagtggctcccactcccagggtgtggcgtaccccgtccgcatcgagtcctcctcagcctcc

SEQ ID NO: 5277 - DNA, 201 bp, Homo sapiens
cactgccctggcagcaccggctggaaggtgacacactcatcataccccgggtagcccagcaggactcgggccagtacatctgcaatgccactagccctgcygggcacgctgaggccaccatcatcctgcacgtggagagcccaccatatgccaccacggtcccagagcacgcttcggtgcaggcaggggagacggtgcagc

SEQ ID NO: 5278 - DNA, 201 bp, Homo sapiens; identical to SEQ ID NO: 5192

SEQ ID NO: 5279 - DNA, 201 bp, Homo sapiens; identical to SEQ ID NO: 5193

SEQ ID NO: 5280 - DNA, 201 bp, Homo sapiens; identical to SEQ ID NO: 5194

SEQ ID NO: 5281 - DNA, 201 bp, Homo sapiens; identical to SEQ ID NO: 5195

SEQ ID NO: 5282 - DNA, 201 bp, Homo sapiens; identical to SEQ ID NO: 5196

SEQ ID NO: 5283 - DNA, 201 bp, Homo sapiens; identical to SEQ ID NO: 5198

SEQ ID NO: 5284 - DNA, 201 bp, Homo sapiens; identical to SEQ ID NO: 5199

SEQ ID NO: 5285 - DNA, 201 bp, Homo sapiens; identical to SEQ ID NO: 5200

SEQ ID NO: 5286 - DNA, 201 bp, Homo sapiens; identical to SEQ ID NO: 5201

SEQ ID NO: 5287 - DNA, 201 bp, Homo sapiens; identical to SEQ ID NO: 5202

SEQ ID NO: 5288 - DNA, 201 bp, Homo sapiens; identical to SEQ ID NO: 5203

SEQ ID NO: 5289 - DNA, 201 bp, Homo sapiens; identical to SEQ ID NO: 5204

SEQ ID NO: 5290 - DNA, 201 bp, Homo sapiens; identical to SEQ ID NO: 5205

SEQ ID NO: 5291 - DNA, 201 bp, Homo sapiens; identical to SEQ ID NO: 5206

SEQ ID NO: 5292 - DNA, 201 bp, Homo sapiens; identical to SEQ ID NO: 5207

SEQ ID NO: 5293 - DNA, 201 bp, Homo sapiens; identical to SEQ ID NO: 5208

SEQ ID NO: 5294 - DNA, 201 bp, Homo sapiens; identical to SEQ ID NO: 5209

SEQ ID NO: 5295 - DNA, 201 bp, Homo sapiens; identical to SEQ ID NO: 5211

SEQ ID NO: 5296 - DNA, 201 bp, Homo sapiens; identical to SEQ ID NO: 5213

SEQ ID NO: 5297 - DNA, 201 bp, Homo sapiens; identical to SEQ ID NO: 5214

SEQ ID NO: 5298 - DNA, 201 bp, Homo sapiens; identical to SEQ ID NO: 5215

SEQ ID NO: 5299 - DNA, 201 bp, Homo sapiens; identical to SEQ ID NO: 5216

SEQ ID NO: 5300 - DNA, 201 bp, Homo sapiens; identical to SEQ ID NO: 5217

SEQ ID NO: 5301 - DNA, 201 bp, Homo sapiens; identical to SEQ ID NO: 5218

SEQ ID NO: 5302 - DNA, 201 bp, Homo sapiens; identical to SEQ ID NO: 5221

SEQ ID NO: 5303 - DNA, 201 bp, Homo sapiens; identical to SEQ ID NO: 5223

SEQ ID NO: 5304 - DNA, 201 bp, Homo sapiens; identical to SEQ ID NO: 5224

SEQ ID NO: 5305 - DNA, 201 bp, Homo sapiens; identical to SEQ ID NO: 5225

SEQ ID NO: 5306 - DNA, 201 bp, Homo sapiens; identical to SEQ ID NO: 5226

SEQ ID NO: 5307 - DNA, 201 bp, Homo sapiens; identical to SEQ ID NO: 5227

SEQ ID NO: 5308 - DNA, 201 bp, Homo sapiens; identical to SEQ ID NO: 5228

SEQ ID NO: 5309 - DNA, 201 bp, Homo sapiens; identical to SEQ ID NO: 5229

SEQ ID NO: 5310 - DNA, 201 bp, Homo sapiens; identical to SEQ ID NO: 5230

SEQ ID NO: 5311 - DNA, 201 bp, Homo sapiens; identical to SEQ ID NO: 5231

SEQ ID NO: 5312 - DNA, 201 bp, Homo sapiens; identical to SEQ ID NO: 5232

SEQ ID NO: 5313 - DNA, 201 bp, Homo sapiens; identical to SEQ ID NO: 5233

SEQ ID NO: 5314 - DNA, 201 bp, Homo sapiens; identical to SEQ ID NO: 5234

SEQ ID NO: 5315 - DNA, 201 bp, Homo sapiens; identical to SEQ ID NO: 5235

SEQ ID NO: 5316 - DNA, 201 bp, Homo sapiens; identical to SEQ ID NO: 5236

SEQ ID NO: 5317 - DNA, 201 bp, Homo sapiens; identical to SEQ ID NO: 5237

SEQ ID NO: 5318 - DNA, 201 bp, Homo sapiens; identical to SEQ ID NO: 5238

SEQ ID NO: 5319 - DNA, 201 bp, Homo sapiens; identical to SEQ ID NO: 5239

SEQ ID NO: 5320 - DNA, 201 bp, Homo sapiens; identical to SEQ ID NO: 5240

SEQ ID NO: 5321 - DNA, 201 bp, Homo sapiens; identical to SEQ ID NO: 5241

SEQ ID NO: 5322 - DNA, 201 bp, Homo sapiens; identical to SEQ ID NO: 5242

SEQ ID NO: 5323 - DNA, 201 bp, Homo sapiens; identical to SEQ ID NO: 5243

SEQ ID NO: 5324 - DNA, 201 bp, Homo sapiens; identical to SEQ ID NO: 5244

SEQ ID NO: 5325 - DNA, 181 bp, Homo sapiens
gctacctgagacgggcatcgcaggagtctctgccacccactcaggattgggaattgtctttagtgccggctgtggagcaaaaggcagctcacccctgggaygcctggcctctgtgtcctagaagggaccctcctgtggtctttgtcttgatttttcttaataaacggtgctatccccgcca

SEQ ID NO: 5326 - DNA, 201 bp, Homo sapiens; identical to SEQ ID NO: 5246

SEQ ID NO: 5327 - DNA, 201 bp, Homo sapiens; identical to SEQ ID NO: 5247

SEQ ID NO: 5328 - DNA, 201 bp, Homo sapiens; identical to SEQ ID NO: 5248

SEQ ID NO: 5329 - DNA, 201 bp, Homo sapiens; identical to SEQ ID NO: 5249

SEQ ID NO: 5330 - DNA, 201 bp, Homo sapiens; identical to SEQ ID NO: 5250

SEQ ID NO: 5331 - DNA, 201 bp, Homo sapiens; identical to SEQ ID NO: 5251

SEQ ID NO: 5332 - DNA, 201 bp, Homo sapiens; identical to SEQ ID NO: 5252

SEQ ID NO: 5333 - DNA, 201 bp, Homo sapiens; identical to SEQ ID NO: 5253

SEQ ID NO: 5334 - DNA, 201 bp, Homo sapiens; identical to SEQ ID NO: 5254

SEQ ID NO: 5335 - DNA, 201 bp, Homo sapiens; identical to SEQ ID NO: 5255

SEQ ID NO: 5336 - DNA, 201 bp, Homo sapiens; identical to SEQ ID NO: 5256

SEQ ID NO: 5337 - DNA, 201 bp, Homo sapiens; identical to SEQ ID NO: 5257

SEQ ID NO: 5338 - DNA, 201 bp, Homo sapiens; identical to SEQ ID NO: 5258

SEQ ID NO: 5339 - DNA, 201 bp, Homo sapiens; identical to SEQ ID NO: 5259

SEQ ID NO: 5340 - DNA, 201 bp, Homo sapiens; identical to SEQ ID NO: 5260

SEQ ID NO: 5341 - DNA, 201 bp, Homo sapiens; identical to SEQ ID NO: 5261

SEQ ID NO: 5342 - DNA, 201 bp, Homo sapiens; identical to SEQ ID NO: 5262

SEQ ID NO: 5343 - DNA, 201 bp, Homo sapiens; identical to SEQ ID NO: 5263

SEQ ID NO: 5344 - DNA, 201 bp, Homo sapiens; identical to SEQ ID NO: 5264

SEQ ID NO: 5345 - DNA, 201 bp, Homo sapiens; identical to SEQ ID NO: 5265

SEQ ID NO: 5346 - DNA, 201 bp, Homo sapiens; identical to SEQ ID NO: 5266

SEQ ID NO: 5347 - DNA, 201 bp, Homo sapiens; identical to SEQ ID NO: 5267

SEQ ID NO: 5348 - DNA, 201 bp, Homo sapiens; identical to SEQ ID NO: 5268

SEQ ID NO: 5349 - DNA, 201 bp, Homo sapiens; identical to SEQ ID NO: 5269

SEQ ID NO: 5350 - DNA, 201 bp, Homo sapiens; identical to SEQ ID NO: 5270

SEQ ID NO: 5351 - DNA, 201 bp, Homo sapiens; identical to SEQ ID NO: 5271

SEQ ID NO: 5352 - DNA, 201 bp, Homo sapiens; identical to SEQ ID NO: 5273

SEQ ID NO: 5353 - DNA, 201 bp, Homo sapiens; identical to SEQ ID NO: 5274

SEQ ID NO: 5354 - DNA, 201 bp, Homo sapiens; identical to SEQ ID NO: 5275

SEQ ID NO: 5355 - DNA, 201 bp, Homo sapiens; identical to SEQ ID NO: 5276

SEQ ID NO: 5356 - DNA, 201 bp, Homo sapiens; identical to SEQ ID NO: 5277

SEQ ID NO: 5357 - DNA, 201 bp, Homo sapiens; identical to SEQ ID NO: 5192

SEQ ID NO: 5358 - DNA, 201 bp, Homo sapiens; identical to SEQ ID NO: 5193

SEQ ID NO: 5359 - DNA, 201 bp, Homo sapiens; identical to SEQ ID NO: 5194

SEQ ID NO: 5360 - DNA, 201 bp, Homo sapiens; identical to SEQ ID NO: 5195

SEQ ID NO: 5361 - DNA, 201 bp, Homo sapiens; identical to SEQ ID NO: 5196

SEQ ID NO: 5362 - DNA, 201 bp, Homo sapiens; identical to SEQ ID NO: 5198

SEQ ID NO: 5363 - DNA, 201 bp, Homo sapiens; identical to SEQ ID NO: 5199

SEQ ID NO: 5364 - DNA, 201 bp, Homo sapiens; identical to SEQ ID NO: 5200

SEQ ID NO: 5365 - DNA, 201 bp, Homo sapiens; identical to SEQ ID NO: 5201

SEQ ID NO: 5366 - DNA, 201 bp, Homo sapiens; identical to SEQ ID NO: 5202

SEQ ID NO: 5367 - DNA, 201 bp, Homo sapiens; identical to SEQ ID NO: 5203

SEQ ID NO: 5368 - DNA, 201 bp, Homo sapiens; identical to SEQ ID NO: 5204

SEQ ID NO: 5369 - DNA, 201 bp, Homo sapiens; identical to SEQ ID NO: 5205

SEQ ID NO: 5370 - DNA, 201 bp, Homo sapiens; identical to SEQ ID NO: 5206

SEQ ID NO: 5371 - DNA, 201 bp, Homo sapiens; identical to SEQ ID NO: 5207

SEQ ID NO: 5372 - DNA, 201 bp, Homo sapiens; identical to SEQ ID NO: 5208

SEQ ID NO: 5373 - DNA, 201 bp, Homo sapiens; identical to SEQ ID NO: 5209

SEQ ID NO: 5374 - DNA, 201 bp, Homo sapiens; identical to SEQ ID NO: 5211

SEQ ID NO: 5375 - DNA, 201 bp, Homo sapiens; identical to SEQ ID NO: 5213

SEQ ID NO: 5376 - DNA, 201 bp, Homo sapiens; identical to SEQ ID NO: 5214

SEQ ID NO: 5377 - DNA, 201 bp, Homo sapiens; identical to SEQ ID NO: 5215

SEQ ID NO: 5378 - DNA, 201 bp, Homo sapiens; identical to SEQ ID NO: 5216

SEQ ID NO: 5379 - DNA, 201 bp, Homo sapiens; identical to SEQ ID NO: 5217

SEQ ID NO: 5380 - DNA, 201 bp, Homo sapiens; identical to SEQ ID NO: 5218

SEQ ID NO: 5381 - DNA, 201 bp, Homo sapiens; identical to SEQ ID NO: 5221

SEQ ID NO: 5382 - DNA, 201 bp, Homo sapiens; identical to SEQ ID NO: 5223

SEQ ID NO: 5383 - DNA, 201 bp, Homo sapiens; identical to SEQ ID NO: 5224

SEQ ID NO: 5384 - DNA, 201 bp, Homo sapiens; identical to SEQ ID NO: 5225

SEQ ID NO: 5385 - DNA, 201 bp, Homo sapiens; identical to SEQ ID NO: 5226

SEQ ID NO: 5386 - DNA, 201 bp, Homo sapiens; identical to SEQ ID NO: 5227

SEQ ID NO: 5387 - DNA, 201 bp, Homo sapiens; identical to SEQ ID NO: 5228

SEQ ID NO: 5388 - DNA, 201 bp, Homo sapiens; identical to SEQ ID NO: 5229

SEQ ID NO: 5389 - DNA, 201 bp, Homo sapiens; identical to SEQ ID NO: 5230

SEQ ID NO: 5390 - DNA, 201 bp, Homo sapiens
ctgggcagtggggacctgggcagcggggacttccagatggggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 5391 - DNA, 201 bp, Homo sapiens
atgctggctgacagcatctcaggagacgacctgggcagtggggacctgggcagcggggacttccagatggggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 5392 - DNA, 201 bp, Homo sapiens; identical to SEQ ID NO: 5233

SEQ ID NO: 5393 - DNA, 201 bp, Homo sapiens; identical to SEQ ID NO: 5234

SEQ ID NO: 5394 - DNA, 201 bp, Homo sapiens; identical to SEQ ID NO: 5235

SEQ ID NO: 5395 - DNA, 201 bp, Homo sapiens; identical to SEQ ID NO: 5236

SEQ ID NO: 5396 - DNA, 201 bp, Homo sapiens; identical to SEQ ID NO: 5237

SEQ ID NO: 5397 - DNA, 201 bp, Homo sapiens; identical to SEQ ID NO: 5238

SEQ ID NO: 5398 - DNA, 201 bp, Homo sapiens; identical to SEQ ID NO: 5239

SEQ ID NO: 5399 - DNA, 201 bp, Homo sapiens; identical to SEQ ID NO: 5240

SEQ ID NO: 5400 - DNA, 201 bp, Homo sapiens; identical to SEQ ID NO: 5241

SEQ ID NO: 5401 - DNA, 201 bp, Homo sapiens; identical to SEQ ID NO: 5242

SEQ ID NO: 5402 - DNA, 201 bp, Homo sapiens; identical to SEQ ID NO: 5243

SEQ ID NO: 5403 - DNA, 201 bp, Homo sapiens; identical to SEQ ID NO: 5244

SEQ ID NO: 5404 - DNA, 181 bp, Homo sapiens; identical to SEQ ID NO: 5325

SEQ ID NO: 5405 - DNA, 201 bp, Homo sapiens; identical to SEQ ID NO: 5246

SEQ ID NO: 5406 - DNA, 201 bp, Homo sapiens; identical to SEQ ID NO: 5247

SEQ ID NO: 5407 - DNA, 201 bp, Homo sapiens; identical to SEQ ID NO: 5248

SEQ ID NO: 5408 - DNA, 201 bp, Homo sapiens; identical to SEQ ID NO: 5249

SEQ ID NO: 5409 - DNA, 201 bp, Homo sapiens; identical to SEQ ID NO: 5251

SEQ ID NO: 5410 - DNA, 201 bp, Homo sapiens; identical to SEQ ID NO: 5250

SEQ ID NO: 5411 - DNA, 201 bp, Homo sapiens; identical to SEQ ID NO: 5252

SEQ ID NO: 5412 - DNA, 201 bp, Homo sapiens; identical to SEQ ID NO: 5253

SEQ ID NO: 5413 - DNA, 201 bp, Homo sapiens; identical to SEQ ID NO: 5254

SEQ ID NO: 5414 - DNA, 201 bp, Homo sapiens; identical to SEQ ID NO: 5255

SEQ ID NO: 5415 - DNA, 201 bp, Homo sapiens; identical to SEQ ID NO: 5256

SEQ ID NO: 5416 - DNA, 201 bp, Homo sapiens; identical to SEQ ID NO: 5257

SEQ ID NO: 5417 - DNA, 201 bp, Homo sapiens; identical to SEQ ID NO: 5258

SEQ ID NO: 5418 - DNA, 201 bp, Homo sapiens; identical to SEQ ID NO: 5259

SEQ ID NO: 5419 - DNA, 201 bp, Homo sapiens; identical to SEQ ID NO: 5260

SEQ ID NO: 5420 - DNA, 201 bp, Homo sapiens; identical to SEQ ID NO: 5262

SEQ ID NO: 5421 - DNA, 201 bp, Homo sapiens; identical to SEQ ID NO: 5263

SEQ ID NO: 5422 - DNA, 201 bp, Homo sapiens
tccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcaggtgcctgagccggc

SEQ ID NO: 5423 - DNA, 201 bp, Homo sapiens; identical to SEQ ID NO: 5265

SEQ ID NO: 5424 - DNA, 201 bp, Homo sapiens; identical to SEQ ID NO: 5266

SEQ ID NO: 5425 - DNA, 201 bp, Homo sapiens; identical to SEQ ID NO: 5267

SEQ ID NO: 5426 - DNA, 201 bp, Homo sapiens
ctgaggacatagagaccgtcacagcaagccaaatgcgctggacacattcgtacctttctgatgatgaggacatgctggctgacagcatctcaggagacgamctgggcagtggggacctgggcagcggggacttccagatggggagctggatggctgggtttttgtggagctggatgtgggctcggaagggaatgcggatgg

SEQ ID NO: 5427 - DNA, 201 bp, Homo sapiens; identical to SEQ ID NO: 5269

SEQ ID NO: 5428 - DNA, 201 bp, Homo sapiens; identical to SEQ ID NO: 5270

SEQ ID NO: 5429 - DNA, 201 bp, Homo sapiens; identical to SEQ ID NO: 5271

SEQ ID NO: 5430 - DNA, 201 bp, Homo sapiens; identical to SEQ ID NO: 5273

SEQ ID NO: 5431 - DNA, 201 bp, Homo sapiens; identical to SEQ ID NO: 5274

SEQ ID NO: 5432 - DNA, 201 bp, Homo sapiens; identical to SEQ ID NO: 5275

SEQ ID NO: 5433 - DNA, 201 bp, Homo sapiens; identical to SEQ ID NO: 5276

SEQ ID NO: 5434 - DNA, 201 bp, Homo sapiens; identical to SEQ ID NO: 5277

SEQ ID NO: 5435 - DNA, 157 bp, Homo sapiens
gcggccgctcccggggcttgggctcgatgggcgtccactgctcgccacgcacagccrcctgcggggcactgaagggttgagccgcgccccagcgcccgccctccctccctccctccctccccggaggcccaccccgctaggggccctgggacaggct

SEQ ID NO: 5436 - DNA, 201 bp, Homo sapiens
gggttgagccgcgccccagcgcccgccctccctccctccctccctccccggaggcccaccccgctaggggccctgggacaggctcaagtctgaatcccacrcaggatggtgtgactgccactcagagaggttaagtgacgcgcccgaggccacacagccaggacctgggtcggcctgacaccagcccaagctatttcttca

SEQ ID NO: 5437 - DNA, 201 bp, Homo sapiens
ggcggagctggtggattcggtcctggatgtggtgcggaaggagtgtgaaaactgcgactgcctgcagggcttccagctgacccactcgctggggggcggcmcgggctccggcatgggcacgttgctcatcagcaaggtgcgtgaggagtatcccgaccgcatcatgaacaccttcagcgtcgtgccctcacccaaggtgtc

SEQ ID NO: 5438 - DNA, 201 bp, Homo sapiens
ggcctgacaatttcatctttggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 5439 - DNA, 201 bp, Homo sapiens
ccagcagtgtctaaacccccggagccatcttgctgccgacaccctgctttcccctcgccctagggctcccttgccgccctcctgcagtatttatggcctcrtcctccccacctaggccacgtgtgagctgctcctgtctctgtcttattgcagctccaggcctgacgttttacggttttgttttttactggtttgtgttta

SEQ ID NO: 5440 - DNA, 151 bp, Homo sapiens
gcctcgtcctccccacctaggccacgtgtgagctgctcctgtctctgtcttattgcagctccaggcctgacgttttacggttttgttttttactggtttgkgtttatattttcggggatacttaataaatctattgctgtcagataccctt

SEQ ID NO: 5441 - DNA, 171 bp, Homo sapiens
gccctcctgcagtatttatggcctcgtcctccccacctaggccacgtgtgagctgctcctgtctctgtcttattgcagctccaggcctgacgttttacggktttgttttttactggtttgtgtttatattttcggggatacttaataaatctattgctgtcagataccctt

SEQ ID NO: 5442 - DNA, 201 bp, Homo sapiens
gtgtccgagtaccagcagtaccaggacgccacggccgaggaagagggcgagatgtacgaagacgacgaggaggagtcggaggcccagggccccaagtgaarctgctcgcagctggagtgagaggcaggtggcggccggggccgaagccagcagtgtctaaacccccggagccatcttgctgccgacaccctgctttcccct

SEQ ID NO: 5443 - DNA, 201 bp, Homo sapiens
tccaccagctggtggagaacacggatgagacctactgcatcgacaacgaggcgctctacgacatctgcttccgcaccctcaagctggccacgcccacctayggggacctcaaccacctggtatcggccaccatgagcggagtcaccacctccttgcgcttcccgggccagctcaacgctgacctgcgcaagctggccgtca

SEQ ID NO: 5444 - DNA, 201 bp, Homo sapiens
acatgatggccgcctgcgacccgcgccacggccgctacctgacggtggccaccgtgttccggggccgcatgtccatgaaggaggtggacgagcagatgctrgccatccagagcaagaacagcagctacttcgtggagtggatccccaacaacgtgaaggtggccgtgtgtgacatcccgccccgcggcctcaagatgtcct

SEQ ID NO: 5445 - DNA, 201 bp, Homo sapiens
cggaggcccagggccccaagtgaagctgctcgcagctggagtgagaggcaggtggcggccggggccgaagccagcagtgtctaaacccccggagccatctygctgccgacaccctgctttcccctcgccctagggctcccttgccgccctcctgcagtatttatggcctcgtcctccccacctaggccacgtgtgagctgc

SEQ ID NO: 5446 - DNA, 139 bp, Homo sapiens
ggactccggggtccaggagcacgaggccttgctgcggtcaagagatcaggacgttcccatgcctgtgtcctggggttgggccgtggatgccacgttcccaygtctgtgtcctggggcggggccgtggatgccacgttcc

SEQ ID NO: 5447 - DNA, 201 bp, Homo sapiens
ggactccggggtccaggagcacgaggccttgctgcggtcaagagatcaggacgttcccatgcctgtgtcctggggttgggccgtggatgccacgttcccaygtctgtgtcctggggcggggccgtggatgccacgttcccacgtctgtgtcctggggcggggccgtggatgccacgttcccacgtctgtgtcctggggcgg

SEQ ID NO: 5448 - DNA, 124 bp, Homo sapiens
ctggggcggggccgtggatgccacgttcccatgcctgtgtcctggggcggggccgtggatgccacgttcccatgtctgtgtcctggggcggggccgtggaygcgccacagaaacaggagggcct

SEQ ID NO: 5449 - DNA, 201 bp, Homo sapiens; identical to SEQ ID NO: 5437

SEQ ID NO: 5450 - DNA, 201 bp, Homo sapiens; identical to SEQ ID NO: 5439

SEQ ID NO: 5451 - DNA, 201 bp, Homo sapiens; identical to SEQ ID NO: 5438

SEQ ID NO: 5452 - DNA, 151 bp, Homo sapiens; identical to SEQ ID NO: 5440

SEQ ID NO: 5453 - DNA, 171 bp, Homo sapiens; identical to SEQ ID NO: 5441

SEQ ID NO: 5454 - DNA, 201 bp, Homo sapiens; identical to SEQ ID NO: 5442

SEQ ID NO: 5455 - DNA, 201 bp, Homo sapiens; identical to SEQ ID NO: 5443

SEQ ID NO: 5456 - DNA, 201 bp, Homo sapiens; identical to SEQ ID NO: 5444

SEQ ID NO: 5457 - DNA, 201 bp, Homo sapiens; identical to SEQ ID NO: 5445

SEQ ID NO: 5458 - DNA, 201 bp, Homo sapiens; identical to SEQ ID NO: 5437

SEQ ID NO: 5459 - DNA, 201 bp, Homo sapiens
ggtggctgtttgggctcctggcactgccagtcggaaggaaggtatgctggagcaggagggctgatccattcacccaggatcccctcaggaggcagagcctygctctgctgtgaccccaagttctcaagaccctgtccagagccctcgtcctgagcactcagcagcatcggctcagggaagccacggcgggtcagagtgggg

SEQ ID NO: 5460 - DNA, 201 bp, Homo sapiens; identical to SEQ ID NO: 5442

SEQ ID NO: 5461 - DNA, 201 bp, Homo sapiens; identical to SEQ ID NO: 5445

SEQ ID NO: 5462 - DNA, 201 bp, Homo sapiens
tcggaaggaaggtatgctggagcaggagggctgatccattcacccaggatcccctcaggaggcagagcctcgctctgctgtgaccccaagttctcaagacyctgtccagagccctcgtcctgagcactcagcagcatcggctcagggaagccacggcgggtcagagtggggccggcaacaactgggccaagggtcactaca

SEQ ID NO: 5463 - DNA, 201 bp, Homo sapiens
attcacccaggatcccctcaggaggcagagcctcgctctgctgtgaccccaagttctcaagaccctgtccagagccctcgtcctgagcactcagcagcatsggctcagggaagccacggcgggtcagagtggggccggcaacaactgggccaagggtcactacacggagggggcggagctggtggattcggtcctggatgt

SEQ ID NO: 5464 - DNA, 201 bp, Homo sapiens; identical to SEQ ID NO: 5439

SEQ ID NO: 5465 - DNA, 201 bp, Homo sapiens
ggctcagggaagccacggcgggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 5466 - DNA, 151 bp, Homo sapiens; identical to SEQ ID NO: 5440

SEQ ID NO: 5467 - DNA, 171 bp, Homo sapiens; identical to SEQ ID NO: 5441

SEQ ID NO: 5468 - DNA, 201 bp, Homo sapiens; identical to SEQ ID NO: 5443

SEQ ID NO: 5469 - DNA, 201 bp, Homo sapiens; identical to SEQ ID NO: 5444

SEQ ID NO: 5470 - DNA, 182 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 5471 - DNA, 201 bp, Homo sapiens
aagggagcttctgtgcatcgcctgagagcagcagggatgacttccaggagggaagggagggcattgtggcccggctaacagagagcctgttcctggacctkctcggagaggagaatgggggcttttgccagcaggacatgggggagtcatgccttcttccaccttcgggaagtacgagtgctcacatgccctgggatgagt

SEQ ID NO: 5472 - DNA, 201 bp, Homo sapiens
gggaagggagggcattgtggcccggctaacagagagcctgttcctggacctgctcggagaggagaatgggggcttttgccagcaggacatgggggagtcaygccttcttccaccttcgggaagtacgagtgctcacatgccctgggatgagttcccaagtgcagggcccaaggaggcacctccctggggcaaggagcagcc

SEQ ID NO: 5473 - DNA, 181 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 5474 - DNA, 201 bp, Homo sapiens
gaagggagggcattgtggcccggctaacagagagcctgttcctggacctgctcggagaggagaatgggggcttttgccagcaggacatgggggagtcatgycttcttccaccttcgggaagtacgagtgctcacatgccctgggatgagttcccaagtgcagggcccaaggaggcacctccctggggcaaggagcagcctc

SEQ ID NO: 5475 - DNA, 201 bp, Homo sapiens
gccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctgctcggagaggagaatgggggcttttgccagcaggacatgggggagtcatgccttctt

SEQ ID NO: 5476 - DNA, 201 bp, Homo sapiens
gggagggcattgtggcccggctaacagagagcctgttcctggacctgctcggagaggagaatgggggcttttgccagcaggacatgggggagtcatgcctycttccaccttcgggaagtacgagtgctcacatgccctgggatgagttcccaagtgcagggcccaaggaggcacctccctggggcaaggagcagcctctcc

SEQ ID NO: 5477 - DNA, 201 bp, Homo sapiens
tgagccagaaacctgggagcagatcctccgccgaaatgtcctccagcatggggcagctgcagcccccgtctcggcccccaccagtggctatcaggagtttrtacatgcggtggagcagggtggcacccaggccagtgcggtggtgggcttgggtcccccaggagaggctggttacaaggccttctcaagcctgcttgccag

SEQ ID NO: 5478 - DNA, 201 bp, Homo sapiens
agggcattgtggcccggctaacagagagcctgttcctggacctgctcggagaggagaatgggggcttttgccagcaggacatgggggagtcatgccttctyccaccttcgggaagtacgagtgctcacatgccctgggatgagttcccaagtgcagggcccaaggaggcacctccctggggcaaggagcagcctctccacc

SEQ ID NO: 5479 - DNA, 201 bp, Homo sapiens
ccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctggg

SEQ ID NO: 5480 - DNA, 201 bp, Homo sapiens
caaaatcgtgaactttgtctccgtgggacccacatacatgagggtctcttaggtgcatgtcctcttgttgctgagtctgcagatgaggactagggcttatycatgcctgggaaatgccacctcctggaaggcagccaggctggcagatttccaaaagacttgaagaaccatggtatgaaggtgattggccccactgacgtt

SEQ ID NO: 5481 - DNA, 201 bp, Homo sapiens
actggaccccgcccagcattgggctgggctcgccacatcccatgagagtagagggcactgggtcgccgtgccccacggcaggcccctgcaggaaaactgargcccttgggcacctcgacttgtgaacgagttgttggctgctccctccacagcttctgcagcagactgtccctgttgtaactgcccaaggcatgttttgcc

SEQ ID NO: 5482 - DNA, 201 bp, Homo sapiens
gcccagcattgggctgggctcgccacatcccatgagagtagagggcactgggtcgccgtgccccacggcaggcccctgcaggaaaactgaggcccttgggmacctcgacttgtgaacgagttgttggctgctccctccacagcttctgcagcagactgtccctgttgtaactgcccaaggcatgttttgcccaccagatca

SEQ ID NO: 5483 - DNA, 201 bp, Homo sapiens
gagggtctcttaggtgcatgtcctcttgttgctgagtctgcagatgaggactagggcttatccatgcctgggaaatgccacctcctggaaggcagccaggstggcagatttccaaaagacttgaagaaccatggtatgaaggtgattggccccactgacgttggcctaacactgggctgcagagactggaccccgcccagc

SEQ ID NO: 5484 - DNA, 201 bp, Homo sapiens
ctgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtga

SEQ ID NO: 5485 - DNA, 201 bp, Homo sapiens
catcctgcccctggcaatgctcagagctcaagccagacccccaaaatcgtgaactttgtctccgtgggacccacatacatgagggtctcttaggtgcatgycctcttgttgctgagtctgcagatgaggactagggcttatccatgcctgggaaatgccacctcctggaaggcagccaggctggcagatttccaaaagact

SEQ ID NO: 5486 - DNA, 201 bp, Homo sapiens
tccatcctgcccctggcaatgctcagagctcaagccagacccccaaaatcgtgaactttgtctccgtgggacccacatacatgagggtctcttaggtgcaygtcctcttgttgctgagtctgcagatgaggactagggcttatccatgcctgggaaatgccacctcctggaaggcagccaggctggcagatttccaaaaga

SEQ ID NO: 5487 - DNA, 201 bp, Homo sapiens
gactaaagcagggacaatttgctgccaaacacccatgcccagctgtatggctgggggctcctcgtatgcatggaacccccagaataaatatgctcagccaycctgtgggccgggcaatccagacagcaggcataaggcaccagttaccctgcatgttggcccagacctcaggtgctagggaaggcgggaaccttgggttga

SEQ ID NO: 5488 - DNA, 201 bp, Homo sapiens
ttcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatggaacccccagaataaatatgctcagcc

SEQ ID NO: 5489 - DNA, 201 bp, Homo sapiens
ttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatga

SEQ ID NO: 5490 - DNA, 201 bp, Homo sapiens
ctcgccccctacaacccccctgagggccccagacccctctccaggtggggttccactggaggccagtctgtgtccggcctccctggcaccctcgggcatcycagagaagagtaaatcctcatcatccttccatcctgcccctggcaatgctcagagctcaagccagacccccaaaatcgtgaactttgtctccgtgggacc

SEQ ID NO: 5491 - DNA, 201 bp, Homo sapiens
gagagcatcagcgtggtgcgatgtgtggagttgtttgaggccccggtggagtgtgaggaggaggaggaggtagaggaagaaaaagggagcttctgtgcatygcctgagagcagcagggatgacttccaggagggaagggagggcattgtggcccggctaacagagagcctgttcctggacctgctcggagaggagaatggg

SEQ ID NO: 5492 - DNA, 201 bp, Homo sapiens
atgtctccgacactctgctgctgacctggagcaacccgtatccccctgacaattacctgtataatcatctcacctatgcagtcaacatttggagtgaaaaygacccggcagatttcagaatctataacgtgacctacctagaaccctccctccgcatcgcagccagcaccctgaagtctgggatttcctacagggcacggg

SEQ ID NO: 5493 - DNA, 201 bp, Homo sapiens
ggagcttctgtgcatcgcctgagagcagcagggatgacttccaggagggaagggagggcattgtggcccggctaacagagagcctgttcctggacctgctyggagaggagaatgggggcttttgccagcaggacatgggggagtcatgccttcttccaccttcgggaagtacgagtgctcacatgccctgggatgagttcc

SEQ ID NO: 5494 - DNA, 201 bp, Homo sapiens
  misc_feature (1)...(201): n = A,T,C or G, or insertion/deletion polymorphism (see Tables 1-2)
ctctacttgcgagtggaagatgaatggtcccaccaattgcagcaccgagctccgcctgttgtaccagctggtttttctgctctccgaagcccacacgtgtntccctgagaacaacggaggcgcggggtgcgtgtgccacctgctcatggatgacgtggtcagtgcggataactatacactggacctgtgggctgggcagca

SEQ ID NO: 5495 - DNA, 201 bp, Homo sapiens
aactatacactggacctgtgggctgggcagcagctgctgtggaagggctccttcaagcccagcgagcatgtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 5496 - DNA, 201 bp, Homo sapiens
gcattgtcatcctggccgtctgcctgttgtgctatgtcagcatcaccaagattaagaaagaatggtgggatcagattcccaacccagcccgcagccgcctsgtggctataataatccaggatgctcaggggtcacagtgggagaagcggtcccgaggccaggaaccagccaagtgcccacactggaagaattgtcttacca

SEQ ID NO: 5497 - DNA, 201 bp, Homo sapiens
aggatgctcaggggtcacagtgggagaagcggtcccgaggccaggaaccagccaagtgcccacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 5498 - DNA, 201 bp, Homo sapiens
caggtggggttccactggaggccagtctgtgtccggcctccctggcaccctcgggcatctcagagaagagtaaatcctcatcatccttccatcctgccccyggcaatgctcagagctcaagccagacccccaaaatcgtgaactttgtctccgtgggacccacatacatgagggtctcttaggtgcatgtcctcttgttgc

SEQ ID NO: 5499 - DNA, 201 bp, Homo sapiens
agcaacagaggacatgaaaaattgctgtgactaaagcagggacaatttgctgccaaacacccatgcccagctgtatggctgggggctcctcgtatgcatgsaacccccagaataaatatgctcagccaccctgtgggccgggcaatccagacagcaggcataaggcaccagttaccctgcatgttggcccagacctcaggt

SEQ ID NO: 5500 - DNA, 201 bp, Homo sapiens
actcctacagggagcccttcgagcagcacctcctgctgggcgtcagcgtttcctgcattgtcatcctggccgtctgcctgttgtgctatgtcagcatcacsaagattaagaaagaatggtgggatcagattcccaacccagcccgcagccgcctcgtggctataataatccaggatgctcaggggtcacagtgggagaagc

SEQ ID NO: 5501 - DNA, 201 bp, Homo sapiens
ccccaacctgagccagaaacctgggagcagatcctccgccgaaatgtcctccagcatggggcagctgcagcccccgtctcggcccccaccagtggctatcrggagtttgtacatgcggtggagcagggtggcacccaggccagtgcggtggtgggcttgggtcccccaggagaggctggttacaaggccttctcaagcctg

SEQ ID NO: 5502 - DNA, 201 bp, Homo sapiens
ccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcat

SEQ ID NO: 5503 - DNA, 201 bp, Homo sapiens
aagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagct

SEQ ID NO: 5504 - DNA, 201 bp, Homo sapiens
gtggcccggctaacagagagcctgttcctggacctgctcggagaggagaatgggggcttttgccagcaggacatgggggagtcatgccttcttccaccttygggaagtacgagtgctcacatgccctgggatgagttcccaagtgcagggcccaaggaggcacctccctggggcaaggagcagcctctccacctggagcca

SEQ ID NO: 5505 - DNA, 201 bp, Homo sapiens
agccatcatgggagtactatgtcagagcgtatgtaactagctgtcaggtctttccccgttgcctcagcctttctacacagactggccttcaacttcccctragtccagaagtagactctttcagcaactctattcaggaatctgcagcaggaaaactgcttcctctattaacatctatgactgaagcacagatgtgtctag

SEQ ID NO: 5506 - DNA, 201 bp, Homo sapiens
tatcagagggtgaggggctggcttactggcagtttgacatactatacagctcagacccaaacccttcacagagagactctaagtgtacatctgacttgcakaactagacgagttgagtcactgttagctctggatataccgttaaattaaacctcaaaatctctccccaggactcttgctcaagcaagtcacgccaaatcc

SEQ ID NO: 5507 - DNA, 201 bp, Homo sapiens
cactgcaacctccgcctcccggattcaagcaattctcctgcctcagcctatctagtagctgggactacaggtgcacgtcaccatgcccggctaatttttgyatttttattagagacggggtttcaccatgttggccaggatggtctcgatctcttgacctcgtgatccccccgcctcggcctcccaaagcgctgggattac

SEQ ID NO: 5508 - DNA, 201 bp, Homo sapiens
gaagcccttagctgactataggaggtgcctcttgtggctccacgtgcttcttacacaccaccccccagcttgagcgatgcctcagccagctcaccctcatycacacaatcgctagaaaacatgcttcaaatattctatctttgaaaagacaccatgcagaaaataagctttcctctgatgtgcggtattttcttcaatgct

SEQ ID NO: 5509 - DNA, 201 bp, Homo sapiens
gagtccagaagtagactctttcagcaactctattcaggaatctgcagcaggaaaactgcttcctctattaacatctatgactgaagcacagatgtgtctartagaaatcacccttcacccaaaagctgggcgcagaaagggaagcccttagctgactataggaggtgcctcttgtggctccacgtgcttcttacacaccac

SEQ ID NO: 5510 - DNA, 201 bp, Homo sapiens
aatttcaaccattaatcatttatcaaacatgaagtctggtgcattaaaggaatatctatcagagggtgaggggctggcttactggcagtttgacatactayacagctcagacccaaacccttcacagagagactctaagtgtacatctgacttgcagaactagacgagttgagtcactgttagctctggatataccgttaa

SEQ ID NO: 5511 - DNA, 201 bp, Homo sapiens
ggtctcgatctcttgacctcgtgatccccccgcctcggcctcccaaagcgctgggattacagggggagccaccgcgcccggcctttcttcagtgcaatttytaaagagaaacttaaatcctgttgtattctttcaacacaagcaatgatacttctcagagtctgctcaaaagctcagctctgtggactccgtgacaaaatg

SEQ ID NO: 5512 - DNA, 185 bp, Homo sapiens
tccattgctttaacattttgaaatttattttggtttctgttcaacaaaaccaaaccacattgggatggcatttacagaagctcaraaaaacattatgcactgaaaaatacttctcattagaccacaacaagctttaaaaaaataaaattaagtaattatagttaagttacaaaaagctgaaagta

SEQ ID NO: 5513 - DNA, 120 bp, Homo sapiens
gtgggacccctcatttgagtcacatccatatggcatggagaaagaaaacctctctgccagaaggaactgaactctggaagtcctaaggaaggtcaccatgmtcagcagataggaaagcat

SEQ ID NO: 5514 - DNA, 201 bp, Homo sapiens
ggaattccacgcaccgatcagtactgggaaaagatctaatctgccgtgggcctgtcgtgccagtcctgggggcgagatcggggtagaaatgcattttattytttaagttcacgtaagatacaagtttcagacagggtctgaaggactggattggccaaacatcagacctgtcttccaaggagaccaagtcctggctacatc

SEQ ID NO: 5515 - DNA, 201 bp, Homo sapiens
acctcagcctcccgagtagtgtcttcaggcctatggagagcagcttgcgtgggctgggcctgcagtacctggtttgcatagatgattggcaggtggatctmggatccggcttccaacatgtggcagctctgggcctccctctgctgcctgctggtgttggccaatgcccggagcaggccctctttccatcccctgtcggat

SEQ ID NO: 5516 - DNA, 201 bp, Homo sapiens
acatgagctacttgaagaggctatgtggtaccttcctgggtgggcccaagccaccccagagagttatgtttaccgaggacctgaagctgcctgcaagcttygatgcacgggaacaatggccacagtgtcccaccatcaaagagatcagagaccagggctcctgtggctcctgctgggccttcggggctgtggaagccatct

SEQ ID NO: 5517 - DNA, 201 bp, Homo sapiens
gggagtacctgctgccccagctgactgtggccccctccgtgatccatccatctccagggagcaagacagagacgcaggaatggaaagcggagttcctaacrggatgaaagttcccccatcagttcccccagtacctccaagcaagtagctttccacatttgtcacagaaatcagaggagagatggtgttgggagccctttg

SEQ ID NO: 5518 - DNA, 139 bp, Homo sapiens
agctctgaaaatctgaggaacattgtaggaaaggtttgttaagcatctcttaagtgccatgatgagcataacagccggccgtggtggctcacgcctgtaakcccagcactttgggaggccaaggtgggaggatgacaag

SEQ ID NO: 5519 - DNA, 201 bp, Homo sapiens
gcctcccgagtagtgtcttcaggcctatggagagcagcttgcgtgggctgggcctgcagtacctggtttgcatagatgattggcaggtggatctaggatcyggcttccaacatgtggcagctctgggcctccctctgctgcctgctggtgttggccaatgcccggagcaggccctctttccatcccctgtcggatgagctg

SEQ ID NO: 5520 - DNA, 157 bp, Homo sapiens
cagatgctagatcaaataagctctgaaaatctgaggaacattgtaggaaaggtttgttaagcatctcttaagtgccatgatgagcataacagccggccgtsgtggctcacgcctgtaatcccagcactttgggaggccaaggtgggaggatgacaag

SEQ ID NO: 5521 - DNA, 201 bp, Homo sapiens
taagtgcctggtaagcttgcccttgcttaagaactcaaaacatagctgtgctctatttttttgttgttgttgtgactgacagagtgagattccgtctcccrggctggagtgcagtggcgccttctcagctcactgcaacctgcagcctcctagattcaagcgattctcctgcttcagccttccgagtagctgggatgacag

SEQ ID NO: 5522 - DNA, 201 bp, Homo sapiens
ctgtgctagttttacagattgcctccttatgacgcggctcaaaaggaaaccaagtggtcaggagttgtttctgacccactgatctctactaccacaaggaraatagtttaggagaaaccagcttttactgtttttgaaaaattacagcttcaccctgtcaagttaacaaggaatgcctgtgccaataaaaggtttctccaa

SEQ ID NO: 5523 - DNA, 201 bp, Homo sapiens
gaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcct

SEQ ID NO: 5524 - DNA, 201 bp, Homo sapiens
ttctttaatagaagttttattttttcgtgcactctgctaatcatgtgggtgagccagtggaacagcgggagacctgtgctagttttacagattgcctcctwatgacgcggctcaaaaggaaaccaagtggtcaggagttgtttctgacccactgatctctactaccacaaggaaaatagtttaggagaaaccagcttttac

SEQ ID NO: 5525 - DNA, 201 bp, Homo sapiens
ggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcc

SEQ ID NO: 5526 - DNA, 201 bp, Homo sapiens
tccttccccctgtagactagtgccgtagggagtacctgctgccccagctgactgtggccccctccgtgatccatccatctccagggagcaagacagagacscaggaatggaaagcggagttcctaacaggatgaaagttcccccatcagttcccccagtacctccaagcaagtagctttccacatttgtcacagaaatcag

SEQ ID NO: 5527 - DNA, 201 bp, Homo sapiens
cgcgcaggctgggctgcaggctctcggctgcagcgctgggctggtgtgcagtggtgcgaccacggctcacggcagcctcagccacccagatgtaagcgatytggttcccacctcagcctcccgagtagtgtcttcaggcctatggagagcagcttgcgtgggctgggcctgcagtacctggtttgcatagatgattggcag

SEQ ID NO: 5528 - DNA, 201 bp, Homo sapiens
catcccagcctgtggttacagtgcagacaggccatgtgagccaccgctgccagcacagagcgtccttccccctgtagactagtgccgtagggagtacctgytgccccagctgactgtggccccctccgtgatccatccatctccagggagcaagacagagacgcaggaatggaaagcggagttcctaacaggatgaaagtt

SEQ ID NO: 5529 - DNA, 201 bp, Homo sapiens
aaagttcccccatcagttcccccagtacctccaagcaagtagctttccacatttgtcacagaaatcagaggagagatggtgttgggagccctttggagaaygccagtctcccaggccccctgcatctatcgagtttgcaatgtcacaacctctctgatcttgtgctcagcatgattctttaatagaagttttattttttcg

SEQ ID NO: 5530 - DNA, 201 bp, Homo sapiens
tctggacaagaaaaggcctggtttctggtggcctctatgaatcccatgtagggtgcagaccgtactccatccctccctgtgagcaccacgtcaacggctcycggcccccatgcacgggggagggagatacccccaagtgtagcaagatctgtgagcctggctacagcccgacctacaaacaggacaagcactacggataca

SEQ ID NO: 5531 - DNA, 201 bp, Homo sapiens
catcaaagagatcagagaccagggctcctgtggctcctgctgggccttcggggctgtggaagccatctctgaccggatctgcatccacaccaatgcgcacrtcagcgtggaggtgtcggcggaggacctgctcacctgctgtggcagcatgtgtggggacggctgtaatggtggctatcctgctgaagcttggaacttctg

SEQ ID NO: 5532 - DNA, 201 bp, Homo sapiens
gagacctgtgctagttttacagattgcctccttatgacgcggctcaaaaggaaaccaagtggtcaggagttgtttctgacccactgatctctactaccacwaggaaaatagtttaggagaaaccagcttttactgtttttgaaaaattacagcttcaccctgtcaagttaacaaggaatgcctgtgccaataaaaggtttc

SEQ ID NO: 5533 - DNA, 201 bp, Homo sapiens
aatcgaatcagaagtggtggctggaattccacgcaccgatcagtactgggaaaagatctaatctgccgtgggcctgtcgtgccagtcctgggggcgagatsggggtagaaatgcattttattctttaagttcacgtaagatacaagtttcagacagggtctgaaggactggattggccaaacatcagacctgtcttccaag

SEQ ID NO: 5534 - DNA, 201 bp, Homo sapiens
cttaacttctcgctgccccagccatgttttcaaccatggcatccctcccccaattagttccctgtcatcctcgtcaaccttctctgtaagtgcctggtaarcttgcccttgcttaagaactcaaaacatagctgtgctctatttttttgttgttgttgtgactgacagagtgagattccgtctcccaggctggagtgcagt

SEQ ID NO: 5535 - DNA, 201 bp, Homo sapiens
gttcttggtatagagcaaactagaagaaccagcaatcattccactgtcctgccaaggtacacctcagtactccccttcccaactgaagtggtatgaggctrgctctttccaaaagcattcaagtttggcttctgatgtgactcagaatttaggaaccagatgctagatcaaataagctctgaaaatctgaggaacattgta

SEQ ID NO: 5536 - DNA, 201 bp, Homo sapiens
aagtggtcaggagttgtttctgacccactgatctctactaccacaaggaaaatagtttaggagaaaccagcttttactgtttttgaaaaattacagcttcmccctgtcaagttaacaaggaatgcctgtgccaataaaaggtttctccaacttgaagtctactctgatgggatctcagatcctttgtcactgcctatagac

SEQ ID NO: 5537 - DNA, 149 bp, Homo sapiens
agatcaaataagctctgaaaatctgaggaacattgtaggaaaggtttgttaagcatctcttaagtgccatgatgagcataacagccggccgtggtggctcrcgcctgtaatcccagcactttgggaggccaaggtgggaggatgacaag

SEQ ID NO: 5538 - DNA, 201 bp, Homo sapiens
cagggtctgaaggactggattggccaaacatcagacctgtcttccaaggagaccaagtcctggctacatcccagcctgtggttacagtgcagacaggccaygtgagccaccgctgccagcacagagcgtccttccccctgtagactagtgccgtagggagtacctgctgccccagctgactgtggccccctccgtgatcca

SEQ ID NO: 5539 - DNA, 201 bp, Homo sapiens
tgctgccccagctgactgtggccccctccgtgatccatccatctccagggagcaagacagagacgcaggaatggaaagcggagttcctaacaggatgaaasttcccccatcagttcccccagtacctccaagcaagtagctttccacatttgtcacagaaatcagaggagagatggtgttgggagccctttggagaacgcc

SEQ ID NO: 5540 - DNA, 201 bp, Homo sapiens
ttcccacctcagcctcccgagtagtgtcttcaggcctatggagagcagcttgcgtgggctgggcctgcagtacctggtttgcatagatgattggcaggtgratctaggatccggcttccaacatgtggcagctctgggcctccctctgctgcctgctggtgttggccaatgcccggagcaggccctctttccatcccctgt

SEQ ID NO: 5541 - DNA, 201 bp, Homo sapiens
ggtttctccaacttgaagtctactctgatgggatctcagatcctttgtcactgcctatagacttgtagctgctgtctctctttgtccctgcagagaatcaygtcctggaactgcatgttcttgcgactcttgggacttcatcttaacttctcgctgccccagccatgttttcaaccatggcatccctcccccaattagttc

SEQ ID NO: 5542 - DNA, 201 bp, Homo sapiens
actgcctatagacttgtagctgctgtctctctttgtccctgcagagaatcacgtcctggaactgcatgttcttgcgactcttgggacttcatcttaacttytcgctgccccagccatgttttcaaccatggcatccctcccccaattagttccctgtcatcctcgtcaaccttctctgtaagtgcctggtaagcttgccct

SEQ ID NO: 5543 - DNA, 201 bp, Homo sapiens
ttgcctccttatgacgcggctcaaaaggaaaccaagtggtcaggagttgtttctgacccactgatctctactaccacaaggaaaatagtttaggagaaacsagcttttactgtttttgaaaaattacagcttcaccctgtcaagttaacaaggaatgcctgtgccaataaaaggtttctccaacttgaagtctactctgat

SEQ ID NO: 5544 - DNA, 201 bp, Homo sapiens
tggtgtcttggtgatctcacataaccaagatgctaccccgtggggaaccacatccccctggatgccctccagccttggtttgggctggagtcagggcctgkatacagtattttgaatttgtatgccactggtttgcattgctggtcaggaactctagtgctttgcatagccctggtttagaaacatgttatagcagttctt

SEQ ID NO: 5545 - DNA, 201 bp, Homo sapiens
caaagtgttgggattacaggtgtgagccactgggccctgcctgtactttttatcagccacaaatccagcaacaagctgaggattcagctcataaaacaggyttggtgtcttggtgatctcacataaccaagatgctaccccgtggggaaccacatccccctggatgccctccagccttggtttgggctggagtcagggcct

SEQ ID NO: 5546 - DNA, 201 bp, Homo sapiens
caggccctctttccatcccctgtcggatgagctggtcaactatgtcaacaaacggaataccacgtggcaggccgggcacaacttctacaacgtggacatgrgctacttgaagaggctatgtggtaccttcctgggtgggcccaagccaccccagagagttatgtttaccgaggacctgaagctgcctgcaagcttcgatgc

SEQ ID NO: 5547 - DNA, 201 bp, Homo sapiens
gagccagtggaacagcgggagacctgtgctagttttacagattgcctccttatgacgcggctcaaaaggaaaccaagtggtcaggagttgtttctgacccmctgatctctactaccacaaggaaaatagtttaggagaaaccagcttttactgtttttgaaaaattacagcttcaccctgtcaagttaacaaggaatgcct

SEQ ID NO: 5548 - DNA, 201 bp, Homo sapiens
tggccaggctagtttcaaactcccggcctcaggtggtctgcctgcctcagcctcccaaagtgttgggattacaggtgtgagccactgggccctgcctgtaytttttatcagccacaaatccagcaacaagctgaggattcagctcataaaacaggtttggtgtcttggtgatctcacataaccaagatgctaccccgtggg

SEQ ID NO: 5549 - DNA, 201 bp, Homo sapiens
aagtacatacaggatttcaccatgttggccaggctagtttcaaactcccggcctcaggtggtctgcctgcctcagcctcccaaagtgttgggattacaggygtgagccactgggccctgcctgtactttttatcagccacaaatccagcaacaagctgaggattcagctcataaaacaggtttggtgtcttggtgatctca

SEQ ID NO: 5550 - DNA, 201 bp, Homo sapiens
aagatctaatctgccgtgggcctgtcgtgccagtcctgggggcgagatcggggtagaaatgcattttattctttaagttcacgtaagatacaagtttcagrcagggtctgaaggactggattggccaaacatcagacctgtcttccaaggagaccaagtcctggctacatcccagcctgtggttacagtgcagacaggcca

SEQ ID NO: 5551 - DNA, 201 bp, Homo sapiens
tagctgggatgacaggcactcaccaatatgcctgggtaatttttgtatttttaagtacatacaggatttcaccatgttggccaggctagtttcaaactccyggcctcaggtggtctgcctgcctcagcctcccaaagtgttgggattacaggtgtgagccactgggccctgcctgtactttttatcagccacaaatccagc

SEQ ID NO: 5552 - DNA, 201 bp, Homo sapiens
gtttcagacagggtctgaaggactggattggccaaacatcagacctgtcttccaaggagaccaagtcctggctacatcccagcctgtggttacagtgcagrcaggccatgtgagccaccgctgccagcacagagcgtccttccccctgtagactagtgccgtagggagtacctgctgccccagctgactgtggccccctcc

SEQ ID NO: 5553 - DNA, 201 bp, Homo sapiens
tacctgctgccccagctgactgtggccccctccgtgatccatccatctccagggagcaagacagagacgcaggaatggaaagcggagttcctaacaggatraaagttcccccatcagttcccccagtacctccaagcaagtagctttccacatttgtcacagaaatcagaggagagatggtgttgggagccctttggagaa

SEQ ID NO: 5554 - DNA, 201 bp, Homo sapiens
cctgctgggccttcggggctgtggaagccatctctgaccggatctgcatccacaccaatgcgcacgtcagcgtggaggtgtcggcggaggacctgctcacvtgctgtggcagcatgtgtggggacggctgtaatggtggctatcctgctgaagcttggaacttctggacaagaaaaggcctggtttctggtggcctctatg

SEQ ID NO: 5555 - DNA, 201 bp, Homo sapiens
gaaagcggagttcctaacaggatgaaagttcccccatcagttcccccagtacctccaagcaagtagctttccacatttgtcacagaaatcagaggagagayggtgttgggagccctttggagaacgccagtctcccaggccccctgcatctatcgagtttgcaatgtcacaacctctctgatcttgtgctcagcatgattc

SEQ ID NO: 5556 - DNA, 201 bp, Homo sapiens
gtggatctaggatccggcttccaacatgtggcagctctgggcctccctctgctgcctgctggtgttggccaatgcccggagcaggccctctttccatcccstgtcggatgagctggtcaactatgtcaacaaacggaataccacgtggcaggccgggcacaacttctacaacgtggacatgagctacttgaagaggctatg

SEQ ID NO: 5557 - DNA, 201 bp, Homo sapiens
cagaaatcagaggagagatggtgttgggagccctttggagaacgccagtctcccaggccccctgcatctatcgagtttgcaatgtcacaacctctctgatsttgtgctcagcatgattctttaatagaagttttattttttcgtgcactctgctaatcatgtgggtgagccagtggaacagcgggagacctgtgctagttt

SEQ ID NO: 5558 - DNA, 201 bp, Homo sapiens
ccacaaggaaaatagtttaggagaaaccagcttttactgtttttgaaaaattacagcttcaccctgtcaagttaacaaggaatgcctgtgccaataaaagktttctccaacttgaagtctactctgatgggatctcagatcctttgtcactgcctatagacttgtagctgctgtctctctttgtccctgcagagaatcacg

SEQ ID NO: 5559 - DNA, 201 bp, Homo sapiens; identical to SEQ ID NO: 5514

SEQ ID NO: 5560 - DNA, 201 bp, Homo sapiens
tctcggctgcagcgctgggtgtcttcaggcctatggagagcagcttgcgtgggctgggcctgcagtacctggtttgcatagatgattggcaggtggatctmggatccggcttccaacatgtggcagctctgggcctccctctgctgcctgctggtgttggccaatgcccggagcaggccctctttccatcccctgtcggat

SEQ ID NO: 5561 - DNA, 201 bp, Homo sapiens; identical to SEQ ID NO: 5516

SEQ ID NO: 5562 - DNA, 201 bp, Homo sapiens; identical to SEQ ID NO: 5517

SEQ ID NO: 5563 - DNA, 139 bp, Homo sapiens; identical to SEQ ID NO: 5518

SEQ ID NO: 5564 - DNA, 201 bp, Homo sapiens
ctgcagcgctgggtgtcttcaggcctatggagagcagcttgcgtgggctgggcctgcagtacctggtttgcatagatgattggcaggtggatctaggatcyggcttccaacatgtggcagctctgggcctccctctgctgcctgctggtgttggccaatgcccggagcaggccctctttccatcccctgtcggatgagctg

SEQ ID NO: 5565 - DNA, 157 bp, Homo sapiens; identical to SEQ ID NO: 5520

SEQ ID NO: 5566 - DNA, 201 bp, Homo sapiens; identical to SEQ ID NO: 5521

SEQ ID NO: 5567 - DNA, 201 bp, Homo sapiens; identical to SEQ ID NO: 5522

SEQ ID NO: 5568 - DNA, 201 bp, Homo sapiens; identical to SEQ ID NO: 5523

SEQ ID NO: 5569 - DNA, 201 bp, Homo sapiens; identical to SEQ ID NO: 5524

SEQ ID NO: 5570 - DNA, 201 bp, Homo sapiens; identical to SEQ ID NO: 5525

SEQ ID NO: 5571 - DNA, 201 bp, Homo sapiens; identical to SEQ ID NO: 5526

SEQ ID NO: 5572 - DNA, 201 bp, Homo sapiens; identical to SEQ ID NO: 5528

SEQ ID NO: 5573 - DNA, 201 bp, Homo sapiens; identical to SEQ ID NO: 5529

SEQ ID NO: 5574 - DNA, 201 bp, Homo sapiens; identical to SEQ ID NO: 5530

SEQ ID NO: 5575 - DNA, 201 bp, Homo sapiens; identical to SEQ ID NO: 5531

SEQ ID NO: 5576 - DNA, 201 bp, Homo sapiens; identical to SEQ ID NO: 5532

SEQ ID NO: 5577 - DNA, 201 bp, Homo sapiens; identical to SEQ ID NO: 5533

SEQ ID NO: 5578 - DNA, 201 bp, Homo sapiens; identical to SEQ ID NO: 5534

SEQ ID NO: 5579 - DNA, 201 bp, Homo sapiens; identical to SEQ ID NO: 5535

SEQ ID NO: 5580 - DNA, 201 bp, Homo sapiens; identical to SEQ ID NO: 5536

SEQ ID NO: 5581 - DNA, 149 bp, Homo sapiens; identical to SEQ ID NO: 5537

SEQ ID NO: 5582 - DNA, 201 bp, Homo sapiens; identical to SEQ ID NO: 5538

SEQ ID NO: 5583 - DNA, 201 bp, Homo sapiens; identical to SEQ ID NO: 5539

SEQ ID NO: 5584 - DNA, 201 bp, Homo sapiens
caggctctcggctgcagcgctgggtgtcttcaggcctatggagagcagcttgcgtgggctgggcctgcagtacctggtttgcatagatgattggcaggtgratctaggatccggcttccaacatgtggcagctctgggcctccctctgctgcctgctggtgttggccaatgcccggagcaggccctctttccatcccctgt

SEQ ID NO: 5585 - DNA, 201 bp, Homo sapiens; identical to SEQ ID NO: 5541

SEQ ID NO: 5586 - DNA, 201 bp, Homo sapiens; identical to SEQ ID NO: 5542

SEQ ID NO: 5587 - DNA, 201 bp, Homo sapiens; identical to SEQ ID NO: 5543

SEQ ID NO: 5588 - DNA, 201 bp, Homo sapiens; identical to SEQ ID NO: 5544

SEQ ID NO: 5589 - DNA, 201 bp, Homo sapiens; identical to SEQ ID NO: 5545

SEQ ID NO: 5590 - DNA, 201 bp, Homo sapiens; identical to SEQ ID NO: 5546

SEQ ID NO: 5591 - DNA, 201 bp, Homo sapiens; identical to SEQ ID NO: 5547

SEQ ID NO: 5592 - DNA, 201 bp, Homo sapiens; identical to SEQ ID NO: 5548

SEQ ID NO: 5593 - DNA, 201 bp, Homo sapiens; identical to SEQ ID NO: 5549

SEQ ID NO: 5594 - DNA, 201 bp, Homo sapiens; identical to SEQ ID NO: 5550

SEQ ID NO: 5595 - DNA, 201 bp, Homo sapiens; identical to SEQ ID NO: 5551

SEQ ID NO: 5596 - DNA, 201 bp, Homo sapiens; identical to SEQ ID NO: 5552

SEQ ID NO: 5597 - DNA, 201 bp, Homo sapiens; identical to SEQ ID NO: 5553

SEQ ID NO: 5598 - DNA, 201 bp, Homo sapiens; identical to SEQ ID NO: 5554

SEQ ID NO: 5599 - DNA, 201 bp, Homo sapiens; identical to SEQ ID NO: 5555

SEQ ID NO: 5600 - DNA, 201 bp, Homo sapiens; identical to SEQ ID NO: 5556

SEQ ID NO: 5601 - DNA, 201 bp, Homo sapiens; identical to SEQ ID NO: 5557

SEQ ID NO: 5602 - DNA, 201 bp, Homo sapiens; identical to SEQ ID NO: 5558

SEQ ID NO: 5603 - DNA, 201 bp, Homo sapiens
caggccctctttccatcccctgtcggatgagctggtcaactatgtcaacaaacggaataccacgtggcaggccgggcacaacttctacaacgtggacatgrgctacttgaagaggctatgtggtaccttcctgggtgggcccaagccaccccagaggtgagtgcctgctcctctgcaccgctgtaatgtgagtggcaggcg

SEQ ID NO: 5604 - DNA, 201 bp, Homo sapiens
ggaagtgggagagtgaaggcctctctggcgtccgcagggctcatgctgcccagggctgccgacaccgcttgaggtacagtacttgtttcttttcatttttrtattactttctttttttattttattttttccttctcaagttattagtagagaagatgctggtgcttttttttggtttttgagagagtctcactctgtcac

SEQ ID NO: 5605 - DNA, 201 bp, Homo sapiens
gtgaaggcctctctggcgtccgcagggctcatgctgcccagggctgccgacaccgcttgaggtacagtacttgtttcttttcatttttgtattactttctytttttattttattttttccttctcaagttattagtagagaagatgctggtgcttttttttggtttttgagagagtctcactctgtcacccaggctggagt

SEQ ID NO: 5606 - DNA, 201 bp, Homo sapiens
gaggctgaggctagagaatcgcatgaacccgggaggcagaggttgcggtgagctgagatgatgccacttcccacgtgaggatggggtagttaagttgcacracactgccttctgcacaatggggatgatatgagaaatgatgagaggatcctgggcagaggttgaggcaggagagcagggcaagaaacactatctggactg

SEQ ID NO: 5607 - DNA, 201 bp, Homo sapiens
agatgctggtgcttttttttggtttttgagagagtctcactctgtcacccaggctggagtgcagtggcacgatcttggctcactgcaaactctgtctcccrggttcaagcgattctcatgccacagcctcctgagtagctggggccacaggcttgcaccaccgtgcacggctaatatttgtatttttagtagagactgggt

SEQ ID NO: 5608 - DNA, 201 bp, Homo sapiens; identical to SEQ ID NO: 5556

SEQ ID NO: 5609 - DNA, 201 bp, Homo sapiens
ggctggcccaggctacggcggcaaccgctccggcaacgccaaccgctccgctgcgcgcaggctgggctgcaggctctcggctgcagcgctgggtggatctmggatccggcttccaacatgtggcagctctgggcctccctctgctgcctgctggtgttggccaatgcccggagcaggccctctttccatcccctgtcggat

SEQ ID NO: 5610 - DNA, 201 bp, Homo sapiens
gccggggctggcccaggctacggcggcaaccgctccggcaacgccaaccgctccgctgcgcgcaggctgggctgcaggctctcggctgcagcgctgggtgratctaggatccggcttccaacatgtggcagctctgggcctccctctgctgcctgctggtgttggccaatgcccggagcaggccctctttccatcccctgt

SEQ ID NO: 5611 - DNA, 201 bp, Homo sapiens
cccaggctacggcggcaaccgctccggcaacgccaaccgctccgctgcgcgcaggctgggctgcaggctctcggctgcagcgctgggtggatctaggatcyggcttccaacatgtggcagctctgggcctccctctgctgcctgctggtgttggccaatgcccggagcaggccctctttccatcccctgtcggatgagctg

SEQ ID NO: 5612 - DNA, 201 bp, Homo sapiens; identical to SEQ ID NO: 5514

SEQ ID NO: 5613 - DNA, 201 bp, Homo sapiens
ctgggctggtgtgcagtggtgcgaccacggctcacggcagcctcagccacccagatgtaagcgatctggttcccacctcagcctcccgagtagtggatctmggatccggcttccaacatgtggcagctctgggcctccctctgctgcctgctggtgttggccaatgcccggagcaggccctctttccatcccctgtcggat

SEQ ID NO: 5614 - DNA, 201 bp, Homo sapiens; identical to SEQ ID NO: 5516

SEQ ID NO: 5615 - DNA, 201 bp, Homo sapiens; identical to SEQ ID NO: 5517

SEQ ID NO: 5616 - DNA, 139 bp, Homo sapiens; identical to SEQ ID NO: 5518

SEQ ID NO: 5617 - DNA, 201 bp, Homo sapiens
tggtgtgcagtggtgcgaccacggctcacggcagcctcagccacccagatgtaagcgatctggttcccacctcagcctcccgagtagtggatctaggatcyggcttccaacatgtggcagctctgggcctccctctgctgcctgctggtgttggccaatgcccggagcaggccctctttccatcccctgtcggatgagctg

SEQ ID NO: 5618 - DNA, 157 bp, Homo sapiens; identical to SEQ ID NO: 5520

SEQ ID NO: 5619 - DNA, 201 bp, Homo sapiens; identical to SEQ ID NO: 5521

SEQ ID NO: 5620 - DNA, 201 bp, Homo sapiens; identical to SEQ ID NO: 5522

SEQ ID NO: 5621 - DNA, 201 bp, Homo sapiens; identical to SEQ ID NO: 5523

SEQ ID NO: 5622 - DNA, 201 bp, Homo sapiens; identical to SEQ ID NO: 5524

SEQ ID NO: 5623 - DNA, 201 bp, Homo sapiens; identical to SEQ ID NO: 5525

SEQ ID NO: 5624 - DNA, 201 bp, Homo sapiens; identical to SEQ ID NO: 5526

SEQ ID NO: 5625 - DNA, 201 bp, Homo sapiens
cgcgcaggctgggctgcaggctctcggctgcagcgctgggctggtgtgcagtggtgcgaccacggctcacggcagcctcagccacccagatgtaagcgatytggttcccacctcagcctcccgagtagtggatctaggatccggcttccaacatgtggcagctctgggcctccctctgctgcctgctggtgttggccaatg

SEQ ID NO: 5626 - DNA, 201 bp, Homo sapiens; identical to SEQ ID NO: 5528

SEQ ID NO: 5627 - DNA, 201 bp, Homo sapiens; identical to SEQ ID NO: 5529

SEQ ID NO: 5628 - DNA, 201 bp, Homo sapiens; identical to SEQ ID NO: 5530

SEQ ID NO: 5629 - DNA, 201 bp, Homo sapiens; identical to SEQ ID NO: 5531

SEQ ID NO: 5630 - DNA, 201 bp, Homo sapiens; identical to SEQ ID NO: 5532

SEQ ID NO: 5631 - DNA, 201 bp, Homo sapiens; identical to SEQ ID NO: 5533

SEQ ID NO: 5632 - DNA, 201 bp, Homo sapiens; identical to SEQ ID NO: 5534

SEQ ID NO: 5633 - DNA, 201 bp, Homo sapiens; identical to SEQ ID NO: 5535

SEQ ID NO: 5634 - DNA, 201 bp, Homo sapiens; identical to SEQ ID NO: 5536

SEQ ID NO: 5635 - DNA, 149 bp, Homo sapiens; identical to SEQ ID NO: 5537

SEQ ID NO: 5636 - DNA, 201 bp, Homo sapiens; identical to SEQ ID NO: 5538

SEQ ID NO: 5637 - DNA, 201 bp, Homo sapiens; identical to SEQ ID NO: 5539

SEQ ID NO: 5638 - DNA, 201 bp, Homo sapiens
cagcgctgggctggtgtgcagtggtgcgaccacggctcacggcagcctcagccacccagatgtaagcgatctggttcccacctcagcctcccgagtagtgratctaggatccggcttccaacatgtggcagctctgggcctccctctgctgcctgctggtgttggccaatgcccggagcaggccctctttccatcccctgt

SEQ ID NO: 5639 - DNA, 201 bp, Homo sapiens; identical to SEQ ID NO: 5541

SEQ ID NO: 5640 - DNA, 201 bp, Homo sapiens; identical to SEQ ID NO: 5542

SEQ ID NO: 5641 - DNA, 201 bp, Homo sapiens; identical to SEQ ID NO: 5543

SEQ ID NO: 5642 - DNA, 201 bp, Homo sapiens; identical to SEQ ID NO: 5544

SEQ ID NO: 5643 - DNA, 201 bp, Homo sapiens; identical to SEQ ID NO: 5545

SEQ ID NO: 5644 - DNA, 201 bp, Homo sapiens; identical to SEQ ID NO: 5546

SEQ ID NO: 5645 - DNA, 201 bp, Homo sapiens; identical to SEQ ID NO: 5547

SEQ ID NO: 5646 - DNA, 201 bp, Homo sapiens; identical to SEQ ID NO: 5548

SEQ ID NO: 5647 - DNA, 201 bp, Homo sapiens; identical to SEQ ID NO: 5549

SEQ ID NO: 5648 - DNA, 201 bp, Homo sapiens; identical to SEQ ID NO: 5550

SEQ ID NO: 5649 - DNA, 201 bp, Homo sapiens; identical to SEQ ID NO: 5551

SEQ ID NO: 5650 - DNA, 201 bp, Homo sapiens; identical to SEQ ID NO: 5552

SEQ ID NO: 5651 - DNA, 201 bp, Homo sapiens; identical to SEQ ID NO: 5553

SEQ ID NO: 5652 - DNA, 201 bp, Homo sapiens; identical to SEQ ID NO: 5554

SEQ ID NO: 5653 - DNA, 201 bp, Homo sapiens; identical to SEQ ID NO: 5555

SEQ ID NO: 5654 - DNA, 201 bp, Homo sapiens; identical to SEQ ID NO: 5556

SEQ ID NO: 5655 - DNA, 201 bp, Homo sapiens; identical to SEQ ID NO: 5557

SEQ ID NO: 5656 - DNA, 201 bp, Homo sapiens; identical to SEQ ID NO: 5558

SEQ ID NO: 5657 - DNA, 188 bp, Homo sapiens
taatacacctcagatcaccacattgatcataactttgtcacctcagttcaatagtttctcctggattcttgtccaagtgagatgacaggtggacgtaacartgccttttcagtctttacctagactctccagagaatcactccagaatagaaattagagtataggtaggcagtccaacctctgcattt

SEQ ID NO: 5658 - DNA, 201 bp, Homo sapiens; identical to SEQ ID NO: 5609

SEQ ID NO: 5659 - DNA, 201 bp, Homo sapiens; identical to SEQ ID NO: 5610

SEQ ID NO: 5660 - DNA, 201 bp, Homo sapiens; identical to SEQ ID NO: 5516

SEQ ID NO: 5661 - DNA, 201 bp, Homo sapiens
aagtggtggctggaattccacgcaccgatcagtactgggaaaagatctaatctgccgtgggcctgtcgtgccagtcctgggggcgagatcgggagaatcaygtcctggaactgcatgttcttgcgactcttgggacttcatcttaacttctcgctgccccagccatgttttcaaccatggcatccctcccccaattagttc

SEQ ID NO: 5662 - DNA, 201 bp, Homo sapiens
agctctgaaaatctgaggaacattgtaggaaaggtttgttaagcatctcttaagtgccatgatgagcataacagccggccgtggtggctcacgcctgtaakcccagcactttgggaggccaaggtgggaggatgacaaggtcaggagttttgagatcagccttggcaacacggtgaaaccccatctctactaaaaatacaa

SEQ ID NO: 5663 - DNA, 201 bp, Homo sapiens; identical to SEQ ID NO: 5611

SEQ ID NO: 5664 - DNA, 201 bp, Homo sapiens
cagatgctagatcaaataagctctgaaaatctgaggaacattgtaggaaaggtttgttaagcatctcttaagtgccatgatgagcataacagccggccgtsgtggctcacgcctgtaatcccagcactttgggaggccaaggtgggaggatgacaaggtcaggagttttgagatcagccttggcaacacggtgaaacccca

SEQ ID NO: 5665 - DNA, 201 bp, Homo sapiens
atctgccgtgggcctgtcgtgccagtcctgggggcgagatcgggagaatcacgtcctggaactgcatgttcttgcgactcttgggacttcatcttaacttytcgctgccccagccatgttttcaaccatggcatccctcccccaattagttccctgtcatcctcgtcaaccttctctgtaagtgcctggtaagcttgccct

SEQ ID NO: 5666 - DNA, 201 bp, Homo sapiens
ctccctgctcccaaactgagttgattcattccatgcgcactgtctccctcacctccatcgtatacgcacctgcagctccttgcctgcttctagcatggagscagcggggatgtgctggtgagtgacaaggaattgtggggcatgtcgacatcagcttaaggctttgttagaaacacctgccttgcagtgtttgtgactggg

SEQ ID NO: 5667 - DNA, 201 bp, Homo sapiens; identical to SEQ ID NO: 5521

SEQ ID NO: 5668 - DNA, 201 bp, Homo sapiens
tccagtttcaagtagaatatattcataacctcaataaagttctccctgctcccaaactgagttgattcattccatgcgcactgtctccctcacctccatcrtatacgcacctgcagctccttgcctgcttctagcatggagccagcggggatgtgctggtgagtgacaaggaattgtggggcatgtcgacatcagcttaag

SEQ ID NO: 5669 - DNA, 201 bp, Homo sapiens
tgcactccagcctgggggacaagagtgaatctgtgtctcaccaaaaaaaaaaagaaaaagaaagatgcttaacaaaggttaccataagccacaaattcatraccacttatccttccagtttcaagtagaatatattcataacctcaataaagttctccctgctcccaaactgagttgattcattccatgcgcactgtctcc

SEQ ID NO: 5670 - DNA, 201 bp, Homo sapiens; identical to SEQ ID NO: 5544

SEQ ID NO: 5671 - DNA, 201 bp, Homo sapiens; identical to SEQ ID NO: 5545

SEQ ID NO: 5672 - DNA, 201 bp, Homo sapiens; identical to SEQ ID NO: 5530

SEQ ID NO: 5673 - DNA, 201 bp, Homo sapiens; identical to SEQ ID NO: 5546

SEQ ID NO: 5674 - DNA, 201 bp, Homo sapiens; identical to SEQ ID NO: 5531

SEQ ID NO: 5675 - DNA, 201 bp, Homo sapiens; identical to SEQ ID NO: 5548

SEQ ID NO: 5676 - DNA, 201 bp, Homo sapiens
aatcgaatcagaagtggtggctggaattccacgcaccgatcagtactgggaaaagatctaatctgccgtgggcctgtcgtgccagtcctgggggcgagatsgggagaatcacgtcctggaactgcatgttcttgcgactcttgggacttcatcttaacttctcgctgccccagccatgttttcaaccatggcatccctccc

SEQ ID NO: 5677 - DNA, 201 bp, Homo sapiens; identical to SEQ ID NO: 5549

SEQ ID NO: 5678 - DNA, 201 bp, Homo sapiens; identical to SEQ ID NO: 5551

SEQ ID NO: 5679 - DNA, 201 bp, Homo sapiens; identical to SEQ ID NO: 5534

SEQ ID NO: 5680 - DNA, 201 bp, Homo sapiens; identical to SEQ ID NO: 5535

SEQ ID NO: 5681 - DNA, 201 bp, Homo sapiens; identical to SEQ ID NO: 5554

SEQ ID NO: 5682 - DNA, 201 bp, Homo sapiens; identical to SEQ ID NO: 5556

SEQ ID NO: 5683 - DNA, 201 bp, Homo sapiens
agatcaaataagctctgaaaatctgaggaacattgtaggaaaggtttgttaagcatctcttaagtgccatgatgagcataacagccggccgtggtggctcrcgcctgtaatcccagcactttgggaggccaaggtgggaggatgacaaggtcaggagttttgagatcagccttggcaacacggtgaaaccccatctctact

SEQ ID NO: 5684 - DNA, 165 bp, Homo sapiens
tgatcataactttgtcacctcagttcaatagtttctcctggattcttgtccaagtgagatgacaggtggacgtaacaatgccttttcagtctttacctagmctctccagagaatcactccagaatagaaattagagtataggtaggcagtccaacctctgcattt

SEQ ID NO: 5685 - DNA, 201 bp, Homo sapiens; identical to SEQ ID NO: 5514

SEQ ID NO: 5686 - DNA, 201 bp, Homo sapiens; identical to SEQ ID NO: 5516

SEQ ID NO: 5687 - DNA, 201 bp, Homo sapiens; identical to SEQ ID NO: 5517

SEQ ID NO: 5688 - DNA, 139 bp, Homo sapiens; identical to SEQ ID NO: 5518

SEQ ID NO: 5689 - DNA, 157 bp, Homo sapiens; identical to SEQ ID NO: 5520

SEQ ID NO: 5690 - DNA, 201 bp, Homo sapiens; identical to SEQ ID NO: 5521

SEQ ID NO: 5691 - DNA, 201 bp, Homo sapiens; identical to SEQ ID NO: 5522

SEQ ID NO: 5692 - DNA, 201 bp, Homo sapiens; identical to SEQ ID NO: 5523

SEQ ID NO: 5693 - DNA, 201 bp, Homo sapiens; identical to SEQ ID NO: 5524

SEQ ID NO: 5694 - DNA, 201 bp, Homo sapiens; identical to SEQ ID NO: 5525

SEQ ID NO: 5695 - DNA, 201 bp, Homo sapiens; identical to SEQ ID NO: 5526

SEQ ID NO: 5696 - DNA, 201 bp, Homo sapiens; identical to SEQ ID NO: 5528

SEQ ID NO: 5697 - DNA, 201 bp, Homo sapiens; identical to SEQ ID NO: 5529

SEQ ID NO: 5698 - DNA, 201 bp, Homo sapiens; identical to SEQ ID NO: 5530

SEQ ID NO: 5699 - DNA, 201 bp, Homo sapiens; identical to SEQ ID NO: 5531

SEQ ID NO: 5700 - DNA, 201 bp, Homo sapiens; identical to SEQ ID NO: 5532

SEQ ID NO: 5701 - DNA, 201 bp, Homo sapiens; identical to SEQ ID NO: 5533

SEQ ID NO: 5702 - DNA, 201 bp, Homo sapiens; identical to SEQ ID NO: 5534

SEQ ID NO: 5703 - DNA, 201 bp, Homo sapiens; identical to SEQ ID NO: 5535

SEQ ID NO: 5704 - DNA, 201 bp, Homo sapiens; identical to SEQ ID NO: 5536

SEQ ID NO: 5705 - DNA, 149 bp, Homo sapiens; identical to SEQ ID NO: 5537

SEQ ID NO: 5706 - DNA, 201 bp, Homo sapiens; identical to SEQ ID NO: 5538

SEQ ID NO: 5707 - DNA, 201 bp, Homo sapiens; identical to SEQ ID NO: 5539

SEQ ID NO: 5708 - DNA, 201 bp, Homo sapiens; identical to SEQ ID NO: 5541

SEQ ID NO: 5709 - DNA, 201 bp, Homo sapiens; identical to SEQ ID NO: 5542

SEQ ID NO: 5710 - DNA, 201 bp, Homo sapiens; identical to SEQ ID NO: 5543

SEQ ID NO: 5711 - DNA, 201 bp, Homo sapiens; identical to SEQ ID NO: 5544

SEQ ID NO: 5712 - DNA, 201 bp, Homo sapiens; identical to SEQ ID NO: 5545

SEQ ID NO: 5713 - DNA, 201 bp, Homo sapiens; identical to SEQ ID NO: 5546

SEQ ID NO: 5714 - DNA, 201 bp, Homo sapiens; identical to SEQ ID NO: 5548

SEQ ID NO: 5715 - DNA, 201 bp, Homo sapiens; identical to SEQ ID NO: 5547

SEQ ID NO: 5716 - DNA, 201 bp, Homo sapiens; identical to SEQ ID NO: 5550

SEQ ID NO: 5717 - DNA, 201 bp, Homo sapiens; identical to SEQ ID NO: 5549

SEQ ID NO: 5718 - DNA, 201 bp, Homo sapiens; identical to SEQ ID NO: 5552

SEQ ID NO: 5719 - DNA, 201 bp, Homo sapiens; identical to SEQ ID NO: 5551

SEQ ID NO: 5720 - DNA, 201 bp, Homo sapiens; identical to SEQ ID NO: 5553

SEQ ID NO: 5721 - DNA, 201 bp, Homo sapiens; identical to SEQ ID NO: 5554

SEQ ID NO: 5722 - DNA, 201 bp, Homo sapiens; identical to SEQ ID NO: 5555

SEQ ID NO: 5723 - DNA, 201 bp, Homo sapiens
tgcaggctctcggctgcagcgctggatgtggcagctctgggcctccctctgctgcctgctggtgttggccaatgcccggagcaggccctctttccatcccstgtcggatgagctggtcaactatgtcaacaaacggaataccacgtggcaggccgggcacaacttctacaacgtggacatgagctacttgaagaggctatg

SEQ ID NO: 5724 - DNA, 201 bp, Homo sapiens; identical to SEQ ID NO: 5557

SEQ ID NO: 5725 - DNA, 201 bp, Homo sapiens; identical to SEQ ID NO: 5558

SEQ ID NO: 5726 - DNA, 201 bp, Homo sapiens; identical to SEQ ID NO: 5514

SEQ ID NO: 5727 - DNA, 201 bp, Homo sapiens
ccaggctggtgtgcagtggtgcgaccacggctcacggcagcctcagccacccagatgtaagcgatctggttcccacctcagcctcccgagtagtggatctmggatccggcttccaacatgtggcagctctgggcctccctctgctgcctgctggtgttggccaatgcccggagcaggccctctttccatcccctgtcggat

SEQ ID NO: 5728 - DNA, 201 bp, Homo sapiens; identical to SEQ ID NO: 5516

SEQ ID NO: 5729 - DNA, 201 bp, Homo sapiens; identical to SEQ ID NO: 5517

SEQ ID NO: 5730 - DNA, 139 bp, Homo sapiens; identical to SEQ ID NO: 5518

SEQ ID NO: 5731 - DNA, 201 bp, Homo sapiens; identical to SEQ ID NO: 5617

SEQ ID NO: 5732 - DNA, 157 bp, Homo sapiens; identical to SEQ ID NO: 5520

SEQ ID NO: 5733 - DNA, 201 bp, Homo sapiens; identical to SEQ ID NO: 5521

SEQ ID NO: 5734 - DNA, 201 bp, Homo sapiens; identical to SEQ ID NO: 5522

SEQ ID NO: 5735 - DNA, 201 bp, Homo sapiens; identical to SEQ ID NO: 5523

SEQ ID NO: 5736 - DNA, 201 bp, Homo sapiens; identical to SEQ ID NO: 5524

SEQ ID NO: 5737 - DNA, 201 bp, Homo sapiens; identical to SEQ ID NO: 5525

SEQ ID NO: 5738 - DNA, 201 bp, Homo sapiens; identical to SEQ ID NO: 5526

SEQ ID NO: 5739 - DNA, 201 bp, Homo sapiens
ctctcggctgcagcgctggggtcttgctttgtctcccaggctggtgtgcagtggtgcgaccacggctcacggcagcctcagccacccagatgtaagcgatytggttcccacctcagcctcccgagtagtggatctaggatccggcttccaacatgtggcagctctgggcctccctctgctgcctgctggtgttggccaatg

SEQ ID NO: 5740 - DNA, 201 bp, Homo sapiens; identical to SEQ ID NO: 5528

SEQ ID NO: 5741 - DNA, 201 bp, Homo sapiens; identical to SEQ ID NO: 5529

SEQ ID NO: 5742 - DNA, 201 bp, Homo sapiens; identical to SEQ ID NO: 5530

SEQ ID NO: 5743 - DNA, 201 bp, Homo sapiens; identical to SEQ ID NO: 5531

SEQ ID NO: 5744 - DNA, 201 bp, Homo sapiens; identical to SEQ ID NO: 5532

SEQ ID NO: 5745 - DNA, 201 bp, Homo sapiens; identical to SEQ ID NO: 5533

SEQ ID NO: 5746 - DNA, 201 bp, Homo sapiens; identical to SEQ ID NO: 5534

SEQ ID NO: 5747 - DNA, 201 bp, Homo sapiens; identical to SEQ ID NO: 5535

SEQ ID NO: 5748 - DNA, 201 bp, Homo sapiens; identical to SEQ ID NO: 5536

SEQ ID NO: 5749 - DNA, 149 bp, Homo sapiens; identical to SEQ ID NO: 5537

SEQ ID NO: 5750 - DNA, 201 bp, Homo sapiens; identical to SEQ ID NO: 5538

SEQ ID NO: 5751 - DNA, 201 bp, Homo sapiens; identical to SEQ ID NO: 5539

SEQ ID NO: 5752 - DNA, 201 bp, Homo sapiens
gtctcccaggctggtgtgcagtggtgcgaccacggctcacggcagcctcagccacccagatgtaagcgatctggttcccacctcagcctcccgagtagtgratctaggatccggcttccaacatgtggcagctctgggcctccctctgctgcctgctggtgttggccaatgcccggagcaggccctctttccatcccctgt

SEQ ID NO: 5753 - DNA, 201 bp, Homo sapiens; identical to SEQ ID NO: 5541

SEQ ID NO: 5754 - DNA, 201 bp, Homo sapiens; identical to SEQ ID NO: 5542

SEQ ID NO: 5755 - DNA, 201 bp, Homo sapiens; identical to SEQ ID NO: 5543

SEQ ID NO: 5756 - DNA, 201 bp, Homo sapiens; identical to SEQ ID NO: 5544

SEQ ID NO: 5757 - DNA, 201 bp, Homo sapiens; identical to SEQ ID NO: 5545

SEQ ID NO: 5758 - DNA, 201 bp, Homo sapiens; identical to SEQ ID NO: 5546

SEQ ID NO: 5759 - DNA, 201 bp, Homo sapiens; identical to SEQ ID NO: 5547

SEQ ID NO: 5760 - DNA, 201 bp, Homo sapiens; identical to SEQ ID NO: 5548

SEQ ID NO: 5761 - DNA, 201 bp, Homo sapiens; identical to SEQ ID NO: 5549

SEQ ID NO: 5762 - DNA, 201 bp, Homo sapiens; identical to SEQ ID NO: 5550

SEQ ID NO: 5763 - DNA, 201 bp, Homo sapiens; identical to SEQ ID NO: 5551

SEQ ID NO: 5764 - DNA, 201 bp, Homo sapiens; identical to SEQ ID NO: 5552

SEQ ID NO: 5765 - DNA, 201 bp, Homo sapiens; identical to SEQ ID NO: 5553

SEQ ID NO: 5766 - DNA, 201 bp, Homo sapiens; identical to SEQ ID NO: 5554

SEQ ID NO: 5767 - DNA, 201 bp, Homo sapiens; identical to SEQ ID NO: 5555

SEQ ID NO: 5768 - DNA, 201 bp, Homo sapiens; identical to SEQ ID NO: 5556

SEQ ID NO: 5769 - DNA, 201 bp, Homo sapiens; identical to SEQ ID NO: 5557

SEQ ID NO: 5770 - DNA, 201 bp, Homo sapiens; identical to SEQ ID NO: 5558

SEQ ID NO: 5771 - DNA, 201 bp, Homo sapiens
agcacagcgatccctgcgccctcaacccgcgcatgaccaggttctccgaggaggcgtgcgcggtcctgacgtcccccacattcgaggcctgccatcgtgcygtcagcccgctgccctacctgcggaactgccgctacgacgtgtgctcctgctcggacggccgcgagtgcctgtgcggcgccctggccagctatgccgcgg

SEQ ID NO: 5772 - DNA, 201 bp, Homo sapiens
accgtggagtaccccttcagcgaggcacagtccaaaggggacatcctgcagcgggtgcgagagatccgctaccagggcggcaacaggaccaacactgggcyggccctgcggtacctctctgaccacagcttcttggtcagccagggtgaccgggagcaggcgcccaacctggtctacatggtcaccggaaatcctgcctct

SEQ ID NO: 5773 - DNA, 201 bp, Homo sapiens
gtagcccgcctccgccagaatgcagaccagtgctgccccgagtatgagtgtgtgtgtgacccagtgagctgtgacctgcccccagtgcctcactgtgaacrtggcctccagcccacactgaccaaccctggcgagtgcagacccaacttcacctgcgcctgcaggaaggaggagtgcaaaagagtgtccccaccctcctgc

SEQ ID NO: 5774 - DNA, 201 bp, Homo sapiens
aaaggagcctatcctgtcggccccccatggtcaagctggtgtgtcccgctgacaacctgcgggctgaagggctcgagtgtaccaaaacgtgccagaactaygacctggagtgcatgagcatgggctgtgtctctggctgcctctgccccccgggcatggtccggcatgagaacagatgtgtggccctggaaaggtgtccct

SEQ ID NO: 5775 - DNA, 201 bp, Homo sapiens
tcccctgtctcatcgcagcaaaaggagcctatcctgtcggccccccatggtcaagctggtgtgtcccgctgacaacctgcgggctgaagggctcgagtgtrccaaaacgtgccagaactatgacctggagtgcatgagcatgggctgtgtctctggctgcctctgccccccgggcatggtccggcatgagaacagatgtgt

SEQ ID NO: 5776 - DNA, 201 bp, Homo sapiens
tctggtggaccccgagccttttgtggccctgtgtgagaagactttgtgtgagtgtgctggggggctggagtgcgcctgccctgccctcctggagtacgccyggacctgtgcccaggagggaatggtgctgtacggctggaccgaccacagcgcgtgcagcccagtgtgccctgctggtatggagtataggcagtgtgtgtc

SEQ ID NO: 5777 - DNA, 201 bp, Homo sapiens
gggtatgagtgtgagtggcgctataacagctgtgcacctgcctgtcaagtcacgtgtcagcaccctgagccactggcctgccctgtgcagtgtgtggaggkctgccatgcccactgccctccagggaaaatcctggatgagcttttgcagacctgcgttgaccctgaagactgtccagtgtgtgaggtggctggccggcgt

SEQ ID NO: 5778 - DNA, 201 bp, Homo sapiens
ggaccccgagccttttgtggccctgtgtgagaagactttgtgtgagtgtgctggggggctggagtgcgcctgccctgccctcctggagtacgcccggaccwgtgcccaggagggaatggtgctgtacggctggaccgaccacagcgcgtgcagcccagtgtgccctgctggtatggagtataggcagtgtgtgtccccttg

SEQ ID NO: 5779 - DNA, 201 bp, Homo sapiens
caaggtggtgacctggaggacggccacattgtgcccccagagctgcgaggagaggaatctccgggagaacgggtatgagtgtgagtggcgctataacagcygtgcacctgcctgtcaagtcacgtgtcagcaccctgagccactggcctgccctgtgcagtgtgtggagggctgccatgcccactgccctccagggaaaat

SEQ ID NO: 5780 - DNA, 201 bp, Homo sapiens
ctgcaacacttgtgtctgtcgggaccggaagtggaactgcacagaccatgtgtgtgatgccacgtgctccacgatcggcatggcccactacctcaccttcracgggctcaaatacctgttccccggggagtgccagtacgttctggtgcaggattactgcggcagtaaccctgggacctttcggatcctagtggggaataa

SEQ ID NO: 5781 - DNA, 201 bp, Homo sapiens
gtcaagtcacgtgtcagcaccctgagccactggcctgccctgtgcagtgtgtggagggctgccatgcccactgccctccagggaaaatcctggatgagctkttgcagacctgcgttgaccctgaagactgtccagtgtgtgaggtggctggccggcgttttgcctcaggaaagaaagtcaccttgaatcccagtgaccctg

SEQ ID NO: 5782 - DNA, 201 bp, Homo sapiens
tcaacaggagcaaggagttcatggaggaggtgattcagcggatggatgtgggccaggacagcatccacgtcacggtgctgcagtactcctacatggtgacygtggagtaccccttcagcgaggcacagtccaaaggggacatcctgcagcgggtgcgagagatccgctaccagggcggcaacaggaccaacactgggctgg

SEQ ID NO: 5783 - DNA, 201 bp, Homo sapiens
aggaggtgattcagcggatggatgtgggccaggacagcatccacgtcacggtgctgcagtactcctacatggtgaccgtggagtaccccttcagcgaggcmcagtccaaaggggacatcctgcagcgggtgcgagagatccgctaccagggcggcaacaggaccaacactgggctggccctgcggtacctctctgaccaca

SEQ ID NO: 5784 - DNA, 201 bp, Homo sapiens
cctctggactcatcccctgccacctgccataacaacatcatgaagcagacgatggtggattcctcctgtagaatccttaccagtgacgtcttccaggactkcaacaagctggtggaccccgagccatatctggatgtctgcatttacgacacctgctcctgtgagtccattggggactgcgcctgcttctgcgacaccatt

SEQ ID NO: 5785 - DNA, 201 bp, Homo sapiens
aacagatgtgtggccctggaaaggtgtccctgcttccatcagggcaaggagtatgcccctggagaaacagtgaagattggctgcaacacttgtgtctgtcrggaccggaagtggaactgcacagaccatgtgtgtgatgccacgtgctccacgatcggcatggcccactacctcaccttcgacgggctcaaatacctgttc

SEQ ID NO: 5786 - DNA, 201 bp, Homo sapiens
ccaggacagcatccacgtcacggtgctgcagtactcctacatggtgaccgtggagtaccccttcagcgaggcacagtccaaaggggacatcctgcagcggktgcgagagatccgctaccagggcggcaacaggaccaacactgggctggccctgcggtacctctctgaccacagcttcttggtcagccagggtgaccggga

SEQ ID NO: 5787 - DNA, 201 bp, Homo sapiens
ggtgaccgtggagtaccccttcagcgaggcacagtccaaaggggacatcctgcagcgggtgcgagagatccgctaccagggcggcaacaggaccaacactrggctggccctgcggtacctctctgaccacagcttcttggtcagccagggtgaccgggagcaggcgcccaacctggtctacatggtcaccggaaatcctgc

SEQ ID NO: 5788 - DNA, 201 bp, Homo sapiens
tgtgtggccctggaaaggtgtccctgcttccatcagggcaaggagtatgcccctggagaaacagtgaagattggctgcaacacttgtgtctgtcgggaccrgaagtggaactgcacagaccatgtgtgtgatgccacgtgctccacgatcggcatggcccactacctcaccttcgacgggctcaaatacctgttccccggg

SEQ ID NO: 5789 - DNA, 201 bp, Homo sapiens
ctgcctatgcccacgtgtgtgcccagcatggcaaggtggtgacctggaggacggccacattgtgcccccagagctgcgaggagaggaatctccgggagaaygggtatgagtgtgagtggcgctataacagctgtgcacctgcctgtcaagtcacgtgtcagcaccctgagccactggcctgccctgtgcagtgtgtggagg

SEQ ID NO: 5790 - DNA, 201 bp, Homo sapiens
atgtgtggccctggaaaggtgtccctgcttccatcagggcaaggagtatgcccctggagaaacagtgaagattggctgcaacacttgtgtctgtcgggacyggaagtggaactgcacagaccatgtgtgtgatgccacgtgctccacgatcggcatggcccactacctcaccttcgacgggctcaaatacctgttccccgg

SEQ ID NO: 5791 - DNA, 201 bp, Homo sapiens
cccttcagcgaggcacagtccaaaggggacatcctgcagcgggtgcgagagatccgctaccagggcggcaacaggaccaacactgggctggccctgcggtrcctctctgaccacagcttcttggtcagccagggtgaccgggagcaggcgcccaacctggtctacatggtcaccggaaatcctgcctctgatgagatcaag

SEQ ID NO: 5792 - DNA, 201 bp, Homo sapiens
tgcgcctgcttctgcgacaccattgctgcctatgcccacgtgtgtgcccagcatggcaaggtggtgacctggaggacggccacattgtgcccccagagctkcgaggagaggaatctccgggagaacgggtatgagtgtgagtggcgctataacagctgtgcacctgcctgtcaagtcacgtgtcagcaccctgagccactg

SEQ ID NO: 5793 - DNA, 201 bp, Homo sapiens
tggctcctccagtttcccagcttcttattttgatgaaatgaagagtttcgccaaggctttcatttcaaaagccaatatagggcctcgtctcactcaggtgwcagtgctgcagtatggaagcatcaccaccattgacgtgccatggaacgtggtcccggagaaagcccatttgctgagccttgtggacgtcatgcagcggga

SEQ ID NO: 5794 - DNA, 201 bp, Homo sapiens
gcttccatcagggcaaggagtatgcccctggagaaacagtgaagattggctgcaacacttgtgtctgtcgggaccggaagtggaactgcacagaccatgtktgtgatgccacgtgctccacgatcggcatggcccactacctcaccttcgacgggctcaaatacctgttccccggggagtgccagtacgttctggtgcagg

SEQ ID NO: 5795 - DNA, 201 bp, Homo sapiens
ggctcaaatacctgttccccggggagtgccagtacgttctggtgcaggattactgcggcagtaaccctgggacctttcggatcctagtggggaataagggmtgcagccacccctcagtgaaatgcaagaaacgggtcaccatcctggtggagggaggagagattgagctgtttgacggggaggtgaatgtgaagaggccca

SEQ ID NO: 5796 - DNA, 201 bp, Homo sapiens
ctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtgggatctgtgatgagaacggagccaatgactt

SEQ ID NO: 5797 - DNA, 201 bp, Homo sapiens
ggggaggacctgcagatggactgggatggccgcgggaggctgctggtgaagctgtcccccgtctatgccgggaagacctgcggcctgtgtgggaattacartggcaaccagggcgacgacttccttaccccctctgggctggcggagccccgggtggaggacttcgggaacgcctggaagctgcacggggactgccaggac

SEQ ID NO: 5798 - DNA, 201 bp, Homo sapiens
tgcctcatcaatgagtgtgtccgagtgaaggaggaggtctttatacaacaaaggaacgtctcctgcccccagctggaggtccctgtctgcccctcgggctwtcagctgagctgtaagacctcagcgtgctgcccaagctgtcgctgtgagcgcatggaggcctgcatgctcaatggcactgtcattgggcccgggaagact

SEQ ID NO: 5799 - DNA, 201 bp, Homo sapiens
aagctgtaagtctgaagtagaggtggatatccactactgccagggcaaatgtgccagcaaagccatgtactccattgacatcaacgatgtgcaggaccagwgctcctgctgctctccgacacggacggagcccatgcaggtggccctgcactgcaccaatggctctgttgtgtaccatgaggttctcaatgccatggagtg

SEQ ID NO: 5800 - DNA, 201 bp, Homo sapiens
ttgtcaatggtaccgtgacacagggggaccaaagagtctccatgccctatgcctccaaagggctgtatctagaaactgaggctgggtactacaagctgtcyggtgaggcctatggctttgtggccaggatcgatggcagcggcaactttcaagtcctgctgtcagacagatacttcaacaagacctgcgggctgtgtggca

SEQ ID NO: 5801 - DNA, 201 bp, Homo sapiens
ccctgagggacagctcctggatgaaggcctctgcgtggagagcaccgagtgtccctgcgtgcattccggaaagcgctaccctcccggcacctccctctctygagactgcaacacctgcatttgccgaaacagccagtggatctgcagcaatgaagaatgtccaggggagtgccttgtcacaggtcaatcacacttcaagag

SEQ ID NO: 5802 - DNA, 201 bp, Homo sapiens
tcctggtggagggaggagagattgagctgtttgacggggaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggagaaagtgtgtg

SEQ ID NO: 5803 - DNA, 201 bp, Homo sapiens
cttcatgctgagggatggcacagtcaccacagactggaaaacacttgttcaggaatggactgtgcagcggccagggcagacgtgccagcccatcctggagkagcagtgtcttgtccccgacagctcccactgccaggtcctcctcttaccactgtttgctgaatgccacaaggtcctggctccagccacattctatgccat

SEQ ID NO: 5804 - DNA, 201 bp, Homo sapiens
cattggggactgcgcctgcttctgcgacaccattgctgcctatgcccacgtgtgtgcccagcatggcaaggtggtgacctggaggacggccacattgtgcrcccagagctgcgaggagaggaatctccgggagaacgggtatgagtgtgagtggcgctataacagctgtgcacctgcctgtcaagtcacgtgtcagcaccc

SEQ ID NO: 5805 - DNA, 201 bp, Homo sapiens
ggtcctcctcttaccactgtttgctgaatgccacaaggtcctggctccagccacattctatgccatctgccagcaggacagttgccaccaggagcaagtgkgtgaggtgatcgcctcttatgcccacctctgtcggaccaacggggtctgcgttgactggaggacacctgatttctgtgctatgtcatgcccaccatctct

SEQ ID NO: 5806 - DNA, 201 bp, Homo sapiens
agcccagtgtgccctgctggtatggagtataggcagtgtgtgtccccttgcgccaggacctgccagagcctgcacatcaatgaaatgtgtcaggagcgatkcgtggatggctgcagctgccctgagggacagctcctggatgaaggcctctgcgtggagagcaccgagtgtccctgcgtgcattccggaaagcgctaccct

SEQ ID NO: 5807 - DNA, 201 bp, Homo sapiens
cgacgtgtgctcctgctcggacggccgcgagtgcctgtgcggcgccctggccagctatgccgcggcctgcgcggggagaggcgtgcgcgtcgcgtggcgckagccaggccgctgtgagctgaactgcccgaaaggccaggtgtacctgcagtgcgggaccccctgcaacctgacctgccgctctctctcttacccggatga

SEQ ID NO: 5808 - DNA, 201 bp, Homo sapiens
tacgttctggtgcaggattactgcggcagtaaccctgggacctttcggatcctagtggggaataagggatgcagccacccctcagtgaaatgcaagaaacrggtcaccatcctggtggagggaggagagattgagctgtttgacggggaggtgaatgtgaagaggcccatgaaggatgagactcactttgaggtggtggag

SEQ ID NO: 5809 - DNA, 201 bp, Homo sapiens
ctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtgctactgtgaggatggcttcatgcactgtac

SEQ ID NO: 5810 - DNA, 201 bp, Homo sapiens
tgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtgtgtgtccaccgaagcaccatctaccctgtgggccagttctgggaggagg

SEQ ID NO: 5811 - DNA, 201 bp, Homo sapiens
agcgtacagtgacggcctccgtgcgcctcagctacggggaggacctgcagatggactgggatggccgcgggaggctgctggtgaagctgtcccccgtctaygccgggaagacctgcggcctgtgtgggaattacaatggcaaccagggcgacgacttccttaccccctctgggctggcggagccccgggtggaggacttcg

SEQ ID NO: 5812 - DNA, 201 bp, Homo sapiens
gcccctgttactatgacggtgagatcttccagccagaagacatcttctcagaccatcacaccatgtgctactgtgaggatggcttcatgcactgtaccatragtggagtccccggaagcttgctgcctgacgctgtcctcagcagtcccctgtctcatcgcagcaaaaggagcctatcctgtcggccccccatggtcaagc

SEQ ID NO: 5813 - DNA, 165 bp, Homo sapiens
atggcaacggtgggcaggggctgagttctgagaccggttctgaggaaggaagcacaggccccatctgcaagcctcagtgtcagtgtgagatactgccaacytctggggaagagtgatgtctttgcctccaggggtgggaaaggcatagcatggggtaggcctctt

SEQ ID NO: 5814 - DNA, 201 bp, Homo sapiens
cctgacgctgtcctcagcagtcccctgtctcatcgcagcaaaaggagcctatcctgtcggccccccatggtcaagctggtgtgtcccgctgacaacctgcrggctgaagggctcgagtgtaccaaaacgtgccagaactatgacctggagtgcatgagcatgggctgtgtctctggctgcctctgccccccgggcatggtc

SEQ ID NO: 5815 - DNA, 201 bp, Homo sapiens
cgggaccggaagtggaactgcacagaccatgtgtgtgatgccacgtgctccacgatcggcatggcccactacctcaccttcgacgggctcaaatacctgtyccccggggagtgccagtacgttctggtgcaggattactgcggcagtaaccctgggacctttcggatcctagtggggaataagggatgcagccacccctca

SEQ ID NO: 5816 - DNA, 201 bp, Homo sapiens
gggctgtatctagaaactgaggctgggtactacaagctgtccggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaagggaccttgacctcggac

SEQ ID NO: 5817 - DNA, 201 bp, Homo sapiens
cagtcccctgtctcatcgcagcaaaaggagcctatcctgtcggccccccatggtcaagctggtgtgtcccgctgacaacctgcgggctgaagggctcgagygtaccaaaacgtgccagaactatgacctggagtgcatgagcatgggctgtgtctctggctgcctctgccccccgggcatggtccggcatgagaacagatg

SEQ ID NO: 5818 - DNA, 201 bp, Homo sapiens
ccattgacatcaacgatgtgcaggaccagtgctcctgctgctctccgacacggacggagcccatgcaggtggccctgcactgcaccaatggctctgttgtktaccatgaggttctcaatgccatggagtgcaaatgctcccccaggaagtgcagcaagtgaggctgctgcagctgcatgggtgcctgctgctgcctgcctt

SEQ ID NO: 5819 - DNA, 201 bp, Homo sapiens
ctgtgtgtgcacaggcagctccactcggcacatcgtgacctttgatgggcagaatttcaagctgactggcagctgttcttatgtcctatttcaaaacaagkagcaggacctggaggtgattctccataatggtgcctgcagccctggagcaaggcagggctgcatgaaatccatcgaggtgaagcacagtgccctctccgt

SEQ ID NO: 5820 - DNA, 201 bp, Homo sapiens
ccagtcttcctggaagagtgtcggctcccagtgggcctccccggagaacccctgcctcatcaatgagtgtgtccgagtgaaggaggaggtctttatacaayaaaggaacgtctcctgcccccagctggaggtccctgtctgcccctcgggctttcagctgagctgtaagacctcagcgtgctgcccaagctgtcgctgtga

SEQ ID NO: 5821 - DNA, 201 bp, Homo sapiens
aagagtctccatgccctatgcctccaaagggctgtatctagaaactgaggctgggtactacaagctgtccggtgaggcctatggctttgtggccaggatcdatggcagcggcaactttcaagtcctgctgtcagacagatacttcaacaagacctgcgggctgtgtggcaactttaacatctttgctgaagatgactttat

SEQ ID NO: 5822 - DNA, 201 bp, Homo sapiens
agcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccagttcctggaagcctgggtcccggaccaccagccctgtcaga

SEQ ID NO: 5823 - DNA, 201 bp, Homo sapiens
cgggtgcgagagatccgctaccagggcggcaacaggaccaacactgggctggccctgcggtacctctctgaccacagcttcttggtcagccagggtgaccrggagcaggcgcccaacctggtctacatggtcaccggaaatcctgcctctgatgagatcaagaggctgcctggagacatccaggtggtgcccattggagtg

SEQ ID NO: 5824 - DNA, 201 bp, Homo sapiens
accactgtttgctgaatgccacaaggtcctggctccagccacattctatgccatctgccagcaggacagttgccaccaggagcaagtgtgtgaggtgatckcctcttatgcccacctctgtcggaccaacggggtctgcgttgactggaggacacctgatttctgtgctatgtcatgcccaccatctctggtctacaacca

SEQ ID NO: 5825 - DNA, 201 bp, Homo sapiens
aaaaggagcctatcctgtcggccccccatggtcaagctggtgtgtcccgctgacaacctgcgggctgaagggctcgagtgtaccaaaacgtgccagaactrtgacctggagtgcatgagcatgggctgtgtctctggctgcctctgccccccgggcatggtccggcatgagaacagatgtgtggccctggaaaggtgtccc

SEQ ID NO: 5826 - DNA, 201 bp, Homo sapiens
agcctgagtgcaacgacatcactgccaggctgcagtatgtcaaggtgggaagctgtaagtctgaagtagaggtggatatccactactgccagggcaaatgkgccagcaaagccatgtactccattgacatcaacgatgtgcaggaccagtgctcctgctgctctccgacacggacggagcccatgcaggtggccctgcact

SEQ ID NO: 5827 - DNA, 201 bp, Homo sapiens
atcgggtcaactgtgaccgggggctgaggccttcgtgccctaacagccagtcccctgttaaagtggaagagacctgtggctgccgctggacctgcccctgygtgtgcacaggcagctccactcggcacatcgtgacctttgatgggcagaatttcaagctgactggcagctgttcttatgtcctatttcaaaacaaggagc

SEQ ID NO: 5828 - DNA, 201 bp, Homo sapiens
gccacattgtgcccccagagctgcgaggagaggaatctccgggagaacgggtatgagtgtgagtggcgctataacagctgtgcacctgcctgtcaagtcaygtgtcagcaccctgagccactggcctgccctgtgcagtgtgtggagggctgccatgcccactgccctccagggaaaatcctggatgagcttttgcagacc

SEQ ID NO: 5829 - DNA, 201 bp, Homo sapiens
agctgtaagtctgaagtagaggtggatatccactactgccagggcaaatgtgccagcaaagccatgtactccattgacatcaacgatgtgcaggaccagtrctcctgctgctctccgacacggacggagcccatgcaggtggccctgcactgcaccaatggctctgttgtgtaccatgaggttctcaatgccatggagtgc

SEQ ID NO: 5830 - DNA, 201 bp, Homo sapiens
caccatgtgctactgtgaggatggcttcatgcactgtaccatgagtggagtccccggaagcttgctgcctgacgctgtcctcagcagtcccctgtctcatygcagcaaaaggagcctatcctgtcggccccccatggtcaagctggtgtgtcccgctgacaacctgcgggctgaagggctcgagtgtaccaaaacgtgcca

SEQ ID NO: 5831 - DNA, 201 bp, Homo sapiens
tccctgaagaggcctgcactcagtgcattggtgaggatggagtccagcaccagttcctggaagcctgggtcccggaccaccagccctgtcagatctgcacrtgcctcagcgggcggaaggtcaactgcacaacgcagccctgccccacggccaaagctcccacgtgtggcctgtgtgaagtagcccgcctccgccagaatg

SEQ ID NO: 5832 - DNA, 201 bp, Homo sapiens
tgctcctgctgctctccgacacggacggagcccatgcaggtggccctgcactgcaccaatggctctgttgtgtaccatgaggttctcaatgccatggagtrcaaatgctcccccaggaagtgcagcaagtgaggctgctgcagctgcatgggtgcctgctgctgcctgccttggcctgatggccaggccagagtgctgcca

SEQ ID NO: 5833 - DNA, 201 bp, Homo sapiens
gcgggtgcgagagatccgctaccagggcggcaacaggaccaacactgggctggccctgcggtacctctctgaccacagcttcttggtcagccagggtgacbgggagcaggcgcccaacctggtctacatggtcaccggaaatcctgcctctgatgagatcaagaggctgcctggagacatccaggtggtgcccattggagt

SEQ ID NO: 5834 - DNA, 201 bp, Homo sapiens
aacaggaccaacactgggctggccctgcggtacctctctgaccacagcttcttggtcagccagggtgaccgggagcaggcgcccaacctggtctacatggwcaccggaaatcctgcctctgatgagatcaagaggctgcctggagacatccaggtggtgcccattggagtgggccctaatgccaacgtgcaggagctggag

SEQ ID NO: 5835 - DNA, 201 bp, Homo sapiens
tcacctgtgaagcctgccaggagccgggaggcctggtggtgcctcccacagatgccccggtgagccccaccactctgtatgtggaggacatctcggaaccrccgttgcacgatttctactgcagcaggctactggacctggtcttcctgctggatggctcctccaggctgtccgaggctgagtttgaagtgctgaaggcct

SEQ ID NO: 5836 - DNA, 201 bp, Homo sapiens
gagtgcctgtgcggcgccctggccagctatgccgcggcctgcgcggggagaggcgtgcgcgtcgcgtggcgcgagccaggccgctgtgagctgaactgccygaaaggccaggtgtacctgcagtgcgggaccccctgcaacctgacctgccgctctctctcttacccggatgaggaatgcaatgaggcctgcctggagggc

SEQ ID NO: 5837 - DNA, 201 bp, Homo sapiens
ctgcacaacagccttgtgaaactgaagcatggggcaggagttgccatggatggccaggacgtccagctccccctcctgaaaggtgacctccgcatccagcrtacagtgacggcctccgtgcgcctcagctacggggaggacctgcagatggactgggatggccgcgggaggctgctggtgaagctgtcccccgtctatgcc

SEQ ID NO: 5838 - DNA, 201 bp, Homo sapiens
cgctgtgtgcacccgctccgtcaccgtccggctgcctggcctgcacaacagccttgtgaaactgaagcatggggcaggagttgccatggatggccaggacrtccagctccccctcctgaaaggtgacctccgcatccagcgtacagtgacggcctccgtgcgcctcagctacggggaggacctgcagatggactgggatgg

SEQ ID NO: 5839 - DNA, 201 bp, Homo sapiens
gaagtatgcgggcagccaggtggcctccaccagcgaggtcttgaaatacacactgttccaaatcttcagcaagatcgaccgccctgaagcctcccgcatcrccctgctcctgatggccagccaggagccccaacggatgtcccggaactttgtccgctacgtccagggcctgaagaagaagaaggtcattgtgatcccggt

SEQ ID NO: 5840 - DNA, 201 bp, Homo sapiens
tctcatcgcagcaaaaggagcctatcctgtcggccccccatggtcaagctggtgtgtcccgctgacaacctgcgggctgaagggctcgagtgtaccaaaaygtgccagaactatgacctggagtgcatgagcatgggctgtgtctctggctgcctctgccccccgggcatggtccggcatgagaacagatgtgtggccctg

SEQ ID NO: 5841 - DNA, 201 bp, Homo sapiens
ggaccgaccacagcgcgtgcagcccagtgtgccctgctggtatggagtataggcagtgtgtgtccccttgcgccaggacctgccagagcctgcacatcaawgaaatgtgtcaggagcgatgcgtggatggctgcagctgccctgagggacagctcctggatgaaggcctctgcgtggagagcaccgagtgtccctgcgtgc

SEQ ID NO: 5842 - DNA, 201 bp, Homo sapiens
agtcccctgtctcatcgcagcaaaaggagcctatcctgtcggccccccatggtcaagctggtgtgtcccgctgacaacctgcgggctgaagggctcgagtrtaccaaaacgtgccagaactatgacctggagtgcatgagcatgggctgtgtctctggctgcctctgccccccgggcatggtccggcatgagaacagatgt

SEQ ID NO: 5843 - DNA, 201 bp, Homo sapiens
tggtgaagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgca

SEQ ID NO: 5844 - DNA, 201 bp, Homo sapiens
cagcagtcccctgtctcatcgcagcaaaaggagcctatcctgtcggccccccatggtcaagctggtgtgtcccgctgacaacctgcgggctgaagggctcragtgtaccaaaacgtgccagaactatgacctggagtgcatgagcatgggctgtgtctctggctgcctctgccccccgggcatggtccggcatgagaacag

SEQ ID NO: 5845 - DNA, 201 bp, Homo sapiens
gtcctcagcagtcccctgtctcatcgcagcaaaaggagcctatcctgtcggccccccatggtcaagctggtgtgtcccgctgacaacctgcgggctgaagrgctcgagtgtaccaaaacgtgccagaactatgacctggagtgcatgagcatgggctgtgtctctggctgcctctgccccccgggcatggtccggcatgag

SEQ ID NO: 5846 - DNA, 201 bp, Homo sapiens
ccaggttctccgaggaggcgtgcgcggtcctgacgtcccccacattcgaggcctgccatcgtgccgtcagcccgctgccctacctgcggaactgccgctamgacgtgtgctcctgctcggacggccgcgagtgcctgtgcggcgccctggccagctatgccgcggcctgcgcggggagaggcgtgcgcgtcgcgtggcgcg

SEQ ID NO: 5847 - DNA, 201 bp, Homo sapiens
gcctgacgctgtcctcagcagtcccctgtctcatcgcagcaaaaggagcctatcctgtcggccccccatggtcaagctggtgtgtcccgctgacaacctgygggctgaagggctcgagtgtaccaaaacgtgccagaactatgacctggagtgcatgagcatgggctgtgtctctggctgcctctgccccccgggcatggt

SEQ ID NO: 5848 - DNA, 201 bp, Homo sapiens
gctacgacgtgtgctcctgctcggacggccgcgagtgcctgtgcggcgccctggccagctatgccgcggcctgcgcggggagaggcgtgcgcgtcgcgtgrcgcgagccaggccgctgtgagctgaactgcccgaaaggccaggtgtacctgcagtgcgggaccccctgcaacctgacctgccgctctctctcttacccgg

SEQ ID NO: 5849 - DNA, 201 bp, Homo sapiens
ggccctcattttgccagggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggggacttccagaatggcaa

SEQ ID NO: 5850 - DNA, 201 bp, Homo sapiens
tgccgggaagacctgcggcctgtgtgggaattacaatggcaaccagggcgacgacttccttaccccctctgggctggcggagccccgggtggaggacttcrggaacgcctggaagctgcacggggactgccaggacctgcagaagcagcacagcgatccctgcgccctcaacccgcgcatgaccaggttctccgaggaggc

SEQ ID NO: 5851 - DNA, 201 bp, Homo sapiens
cgtgctgagcagtgtggatgagctggagcagcaaagggacgagatcgttagctacctctgtgaccttgcccctgaagcccctcctcctactctgccccccsacatggcacaagtcactgtgggcccggggctcttgggggtttcgaccctggggcccaagaggaactccatggttctggatgtggcgttcgtcctggaagg

SEQ ID NO: 5852 - DNA, 201 bp, Homo sapiens
gcccacaataaaggctgagctcttatcttgcaaaaggctgctggtgcactgtgtcgtagggctgagatggcaacggtgggcaggggctgagttctgagacyggttctgaggaaggaagcacaggccccatctgcaagcctcagtgtcagtgtgagatactgccaacctctggggaagagtgatgtctttgcctccaggggt

SEQ ID NO: 5853 - DNA, 201 bp, Homo sapiens
gctggccctgcggtacctctctgaccacagcttcttggtcagccagggtgaccgggagcaggcgcccaacctggtctacatggtcaccggaaatcctgccyctgatgagatcaagaggctgcctggagacatccaggtggtgcccattggagtgggccctaatgccaacgtgcaggagctggagaggattggctggcccaa

SEQ ID NO: 5854 - DNA, 201 bp, Homo sapiens
taagtctgaagtagaggtggatatccactactgccagggcaaatgtgccagcaaagccatgtactccattgacatcaacgatgtgcaggaccagtgctccygctgctctccgacacggacggagcccatgcaggtggccctgcactgcaccaatggctctgttgtgtaccatgaggttctcaatgccatggagtgcaaatg

SEQ ID NO: 5855 - DNA, 201 bp, Homo sapiens
tgatactcacttctgcaaggtcaatgagagaggagagtacttctgggagaagagggtcacaggctgcccaccctttgatgaacacaagtgtctggctgagrgaggtaaaattatgaaaattccaggcacctgctgtgacacatgtgaggagcctgagtgcaacgacatcactgccaggctgcagtatgtcaaggtgggaag

SEQ ID NO: 5856 - DNA, 201 bp, Homo sapiens
ttcctggaagagtgtcggctcccagtgggcctccccggagaacccctgcctcatcaatgagtgtgtccgagtgaaggaggaggtctttatacaacaaaggwacgtctcctgcccccagctggaggtccctgtctgcccctcgggctttcagctgagctgtaagacctcagcgtgctgcccaagctgtcgctgtgagcgcat

SEQ ID NO: 5857 - DNA, 201 bp, Homo sapiens
cctgacgtcccccacattcgaggcctgccatcgtgccgtcagcccgctgccctacctgcggaactgccgctacgacgtgtgctcctgctcggacggccgckagtgcctgtgcggcgccctggccagctatgccgcggcctgcgcggggagaggcgtgcgcgtcgcgtggcgcgagccaggccgctgtgagctgaactgccc

SEQ ID NO: 5858 - DNA, 201 bp, Homo sapiens
ccacattcgaggcctgccatcgtgccgtcagcccgctgccctacctgcggaactgccgctacgacgtgtgctcctgctcggacggccgcgagtgcctgtgsggcgccctggccagctatgccgcggcctgcgcggggagaggcgtgcgcgtcgcgtggcgcgagccaggccgctgtgagctgaactgcccgaaaggccagg

SEQ ID NO: 5859 - DNA, 201 bp, Homo sapiens
tggagcggctgcgcatctcccagaagtgggtccgcgtggccgtggtggagtaccacgacggctcccacgcctacatcgggctcaaggaccggaagcgaccrtcagagctgcggcgcattgccagccaggtgaagtatgcgggcagccaggtggcctccaccagcgaggtcttgaaatacacactgttccaaatcttcagca

SEQ ID NO: 5860 - DNA, 201 bp, Homo sapiens
cctactctgccccccgacatggcacaagtcactgtgggcccggggctcttgggggtttcgaccctggggcccaagaggaactccatggttctggatgtggmgttcgtcctggaaggatcggacaaaattggtgaagccgacttcaacaggagcaaggagttcatggaggaggtgattcagcggatggatgtgggccaggac

SEQ ID NO: 5861 - DNA, 201 bp, Homo sapiens
ggtgactggctcaccgcggggggactcccagtcttcctggaagagtgtcggctcccagtgggcctccccggagaacccctgcctcatcaatgagtgtgtcygagtgaaggaggaggtctttatacaacaaaggaacgtctcctgcccccagctggaggtccctgtctgcccctcgggctttcagctgagctgtaagacctc

SEQ ID NO: 5862 - DNA, 201 bp, Homo sapiens
ccagtgagctgtgacctgcccccagtgcctcactgtgaacgtggcctccagcccacactgaccaaccctggcgagtgcagacccaacttcacctgcgcctkcaggaaggaggagtgcaaaagagtgtccccaccctcctgccccccgcaccgtttgcccacccttcggaagacccagtgctgtgatgagtatgagtgtgcc

SEQ ID NO: 5863 - DNA, 201 bp, Homo sapiens
ctcccggcacctccctctctcgagactgcaacacctgcatttgccgaaacagccagtggatctgcagcaatgaagaatgtccaggggagtgccttgtcacwggtcaatcacacttcaagagctttgacaacagatacttcaccttcagtgggatctgccagtacctgctggcccgggattgccaggaccactccttctcca

SEQ ID NO: 5864 - DNA, 201 bp, Homo sapiens
cctccctctctcgagactgcaacacctgcatttgccgaaacagccagtggatctgcagcaatgaagaatgtccaggggagtgccttgtcacaggtcaatcmcacttcaagagctttgacaacagatacttcaccttcagtgggatctgccagtacctgctggcccgggattgccaggaccactccttctccattgtcattg

SEQ ID NO: 5865 - DNA, 201 bp, Homo sapiens
gccatcgtgccgtcagcccgctgccctacctgcggaactgccgctacgacgtgtgctcctgctcggacggccgcgagtgcctgtgcggcgccctggccagytatgccgcggcctgcgcggggagaggcgtgcgcgtcgcgtggcgcgagccaggccgctgtgagctgaactgcccgaaaggccaggtgtacctgcagtgcg

SEQ ID NO: 5866 - DNA, 201 bp, Homo sapiens; identical to SEQ ID NO: 5800

SEQ ID NO: 5867 - DNA, 201 bp, Homo sapiens
tagagccaaaatcagagggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggggacttccagaatggcaa

SEQ ID NO: 5868 - DNA, 201 bp, Homo sapiens; identical to SEQ ID NO: 5816

SEQ ID NO: 5869 - DNA, 201 bp, Homo sapiens; identical to SEQ ID NO: 5821

SEQ ID NO: 5870 - DNA, 190 bp, Homo sapiens
tagagccaaaatcagagggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggtgagttc

SEQ ID NO: 5871 - DNA, 201 bp, Homo sapiens; identical to SEQ ID NO: 5771

SEQ ID NO: 5872 - DNA, 201 bp, Homo sapiens; identical to SEQ ID NO: 5772

SEQ ID NO: 5873 - DNA, 201 bp, Homo sapiens; identical to SEQ ID NO: 5773

SEQ ID NO: 5874 - DNA, 201 bp, Homo sapiens; identical to SEQ ID NO: 5774

SEQ ID NO: 5875 - DNA, 201 bp, Homo sapiens; identical to SEQ ID NO: 5775

SEQ ID NO: 5876 - DNA, 201 bp, Homo sapiens; identical to SEQ ID NO: 5776

SEQ ID NO: 5877 - DNA, 201 bp, Homo sapiens; identical to SEQ ID NO: 5777

SEQ ID NO: 5878 - DNA, 201 bp, Homo sapiens; identical to SEQ ID NO: 5778

SEQ ID NO: 5879 - DNA, 201 bp, Homo sapiens; identical to SEQ ID NO: 5779

SEQ ID NO: 5880 - DNA, 201 bp, Homo sapiens; identical to SEQ ID NO: 5780

SEQ ID NO: 5881 - DNA, 201 bp, Homo sapiens; identical to SEQ ID NO: 5781

SEQ ID NO: 5882 - DNA, 201 bp, Homo sapiens; identical to SEQ ID NO: 5782

SEQ ID NO: 5883 - DNA, 201 bp, Homo sapiens; identical to SEQ ID NO: 5783

SEQ ID NO: 5884 - DNA, 201 bp, Homo sapiens; identical to SEQ ID NO: 5784

SEQ ID NO: 5885 - DNA, 201 bp, Homo sapiens; identical to SEQ ID NO: 5785

SEQ ID NO: 5886 - DNA, 201 bp, Homo sapiens; identical to SEQ ID NO: 5786

SEQ ID NO: 5887 - DNA, 201 bp, Homo sapiens; identical to SEQ ID NO: 5787

SEQ ID NO: 5888 - DNA, 201 bp, Homo sapiens; identical to SEQ ID NO: 5788

SEQ ID NO: 5889 - DNA, 201 bp, Homo sapiens; identical to SEQ ID NO: 5789

SEQ ID NO: 5890 - DNA, 201 bp, Homo sapiens; identical to SEQ ID NO: 5790

SEQ ID NO: 5891 - DNA, 201 bp, Homo sapiens; identical to SEQ ID NO: 5791

SEQ ID NO: 5892 - DNA, 201 bp, Homo sapiens; identical to SEQ ID NO: 5792

SEQ ID NO: 5893 - DNA, 201 bp, Homo sapiens; identical to SEQ ID NO: 5793

SEQ ID NO: 5894 - DNA, 201 bp, Homo sapiens; identical to SEQ ID NO: 5794

SEQ ID NO: 5895 - DNA, 201 bp, Homo sapiens; identical to SEQ ID NO: 5795

SEQ ID NO: 5896 - DNA, 201 bp, Homo sapiens; identical to SEQ ID NO: 5796

SEQ ID NO: 5897 - DNA, 201 bp, Homo sapiens; identical to SEQ ID NO: 5797

SEQ ID NO: 5898 - DNA, 201 bp, Homo sapiens; identical to SEQ ID NO: 5798

SEQ ID NO: 5899 - DNA, 201 bp, Homo sapiens; identical to SEQ ID NO: 5799

SEQ ID NO: 5900 - DNA, 201 bp, Homo sapiens; identical to SEQ ID NO: 5800

SEQ ID NO: 5901 - DNA, 201 bp, Homo sapiens; identical to SEQ ID NO: 5801

SEQ ID NO: 5902 - DNA, 201 bp, Homo sapiens; identical to SEQ ID NO: 5802

SEQ ID NO: 5903 - DNA, 201 bp, Homo sapiens; identical to SEQ ID NO: 5803

SEQ ID NO: 5904 - DNA, 201 bp, Homo sapiens; identical to SEQ ID NO: 5804

SEQ ID NO: 5905 - DNA, 201 bp, Homo sapiens; identical to SEQ ID NO: 5805

SEQ ID NO: 5906 - DNA, 201 bp, Homo sapiens; identical to SEQ ID NO: 5806

SEQ ID NO: 5907 - DNA, 201 bp, Homo sapiens; identical to SEQ ID NO: 5807

SEQ ID NO: 5908 - DNA, 201 bp, Homo sapiens; identical to SEQ ID NO: 5808

SEQ ID NO: 5909 - DNA, 201 bp, Homo sapiens; identical to SEQ ID NO: 5809

SEQ ID NO: 5910 - DNA, 201 bp, Homo sapiens; identical to SEQ ID NO: 5810

SEQ ID NO: 5911 - DNA, 201 bp, Homo sapiens; identical to SEQ ID NO: 5811

SEQ ID NO: 5912 - DNA, 201 bp, Homo sapiens; identical to SEQ ID NO: 5812

SEQ ID NO: 5913 - DNA, 165 bp, Homo sapiens; identical to SEQ ID NO: 5813

SEQ ID NO: 5914 - DNA, 201 bp, Homo sapiens; identical to SEQ ID NO: 5814

SEQ ID NO: 5915 - DNA, 201 bp, Homo sapiens; identical to SEQ ID NO: 5815

SEQ ID NO: 5916 - DNA, 201 bp, Homo sapiens; identical to SEQ ID NO: 5816

SEQ ID NO: 5917 - DNA, 201 bp, Homo sapiens; identical to SEQ ID NO: 5817

SEQ ID NO: 5918 - DNA, 201 bp, Homo sapiens; identical to SEQ ID NO: 5818

SEQ ID NO: 5919 - DNA, 201 bp, Homo sapiens; identical to SEQ ID NO: 5819

SEQ ID NO: 5920 - DNA, 201 bp, Homo sapiens; identical to SEQ ID NO: 5820

SEQ ID NO: 5921 - DNA, 201 bp, Homo sapiens; identical to SEQ ID NO: 5821

SEQ ID NO: 5922 - DNA, 201 bp, Homo sapiens; identical to SEQ ID NO: 5822

SEQ ID NO: 5923 - DNA, 201 bp, Homo sapiens; identical to SEQ ID NO: 5823

SEQ ID NO: 5924 - DNA, 201 bp, Homo sapiens; identical to SEQ ID NO: 5824

SEQ ID NO: 5925 - DNA, 201 bp, Homo sapiens; identical to SEQ ID NO: 5825

SEQ ID NO: 5926 - DNA, 201 bp, Homo sapiens; identical to SEQ ID NO: 5826

SEQ ID NO: 5927 - DNA, 201 bp, Homo sapiens; identical to SEQ ID NO: 5827

SEQ ID NO: 5928 - DNA, 201 bp, Homo sapiens; identical to SEQ ID NO: 5828

SEQ ID NO: 5929 - DNA, 201 bp, Homo sapiens; identical to SEQ ID NO: 5829

SEQ ID NO: 5930 - DNA, 201 bp, Homo sapiens; identical to SEQ ID NO: 5830

SEQ ID NO: 5931 - DNA, 201 bp, Homo sapiens; identical to SEQ ID NO: 5831

SEQ ID NO: 5932 - DNA, 201 bp, Homo sapiens; identical to SEQ ID NO: 5832

SEQ ID NO: 5933 - DNA, 201 bp, Homo sapiens; identical to SEQ ID NO: 5833

SEQ ID NO: 5934 - DNA, 201 bp, Homo sapiens; identical to SEQ ID NO: 5834

SEQ ID NO: 5935 - DNA, 201 bp, Homo sapiens; identical to SEQ ID NO: 5835

SEQ ID NO: 5936 - DNA, 201 bp, Homo sapiens; identical to SEQ ID NO: 5836

SEQ ID NO: 5937 - DNA, 201 bp, Homo sapiens; identical to SEQ ID NO: 5837

SEQ ID NO: 5938 - DNA, 201 bp, Homo sapiens; identical to SEQ ID NO: 5838

SEQ ID NO: 5939 - DNA, 201 bp, Homo sapiens; identical to SEQ ID NO: 5839

SEQ ID NO: 5940 - DNA, 201 bp, Homo sapiens; identical to SEQ ID NO: 5840

SEQ ID NO: 5941 - DNA, 201 bp, Homo sapiens; identical to SEQ ID NO: 5841

SEQ ID NO: 5942 - DNA, 201 bp, Homo sapiens; identical to SEQ ID NO: 5842

SEQ ID NO: 5943 - DNA, 201 bp, Homo sapiens; identical to SEQ ID NO: 5843

SEQ ID NO: 5944 - DNA, 201 bp, Homo sapiens; identical to SEQ ID NO: 5844

SEQ ID NO: 5945 - DNA, 201 bp, Homo sapiens; identical to SEQ ID NO: 5845

SEQ ID NO: 5946 - DNA, 201 bp, Homo sapiens; identical to SEQ ID NO: 5846

SEQ ID NO: 5947 - DNA, 201 bp, Homo sapiens; identical to SEQ ID NO: 5847

SEQ ID NO: 5948 - DNA, 201 bp, Homo sapiens; identical to SEQ ID NO: 5848

SEQ ID NO: 5949 - DNA, 201 bp, Homo sapiens
gcaggggaaggtatggcggaccctttgtgcagaaggaactcgcggcaggtcatccacggcccgatgcagccttttcggaagtgacttcgtcaacacctttsatgggagcatgtacagctttgcgggatactgcagttacctcctggcagggggctgccagaaacgctccttctcgattattggggacttccagaatggcaa

SEQ ID NO: 5950 - DNA, 201 bp, Homo sapiens; identical to SEQ ID NO: 5850

SEQ ID NO: 5951 - DNA, 201 bp, Homo sapiens; identical to SEQ ID NO: 5851

SEQ ID NO: 5952 - DNA, 201 bp, Homo sapiens; identical to SEQ ID NO: 5852

SEQ ID NO: 5953 - DNA, 201 bp, Homo sapiens; identical to SEQ ID NO: 5853

SEQ ID NO: 5954 - DNA, 201 bp, Homo sapiens; identical to SEQ ID NO: 5854

SEQ ID NO: 5955 - DNA, 201 bp, Homo sapiens; identical to SEQ ID NO: 5855

SEQ ID NO: 5956 - DNA, 201 bp, Homo sapiens; identical to SEQ ID NO: 5856

SEQ ID NO: 5957 - DNA, 201 bp, Homo sapiens; identical to SEQ ID NO: 5857

SEQ ID NO: 5958 - DNA, 201 bp, Homo sapiens; identical to SEQ ID NO: 5858

SEQ ID NO: 5959 - DNA, 201 bp, Homo sapiens; identical to SEQ ID NO: 5859

SEQ ID NO: 5960 - DNA, 201 bp, Homo sapiens; identical to SEQ ID NO: 5860

SEQ ID NO: 5961 - DNA, 201 bp, Homo sapiens; identical to SEQ ID NO: 5861

SEQ ID NO: 5962 - DNA, 201 bp, Homo sapiens; identical to SEQ ID NO: 5862

SEQ ID NO: 5963 - DNA, 201 bp, Homo sapiens; identical to SEQ ID NO: 5863

SEQ ID NO: 5964 - DNA, 201 bp, Homo sapiens; identical to SEQ ID NO: 5864

SEQ ID NO: 5965 - DNA, 201 bp, Homo sapiens; identical to SEQ ID NO: 5865

SEQ ID NO: 5966 - DNA, 201 bp, Homo sapiens
agagagttattttattcctgaagtccggatctatgactcagggacatataaatgtactgtgattgtgaacaacaaagagaaaaccactgcagagtaccagstgttggtggaaggagtgcccagtcccagggtgacactggacaagaaagaggccatccaaggtgggatcgtgagggtcaactgttctgtcccagaggaaaa

SEQ ID NO: 5967 - DNA, 201 bp, Homo sapiens
ctgtttttgtctacactctttctcttttcctctaccatgctgaaggctgaaagacaggaagatggtgccatcagcaaatattattcttaattgaaaacttraaatgtgtatgtttcttactaatttttaaaaatgtattccttgccagggcaggcaaggtggctcacgcctgtaatcccagcacttcaggaggctgaggtg

SEQ ID NO: 5968 - DNA, 201 bp, Homo sapiens
tggagaatagtaccaagaactcaaatgatcctgcggtattcaaagacaaccccactgaagacgtcgaataccagtgtgttgcagataattgccattcccaygccaaaatgttaagtgaggttctgagggtgaaggtgatagccccggtggatgaggtccagatttctatcctgtcaagtaaggtggtggagtctggagagg

SEQ ID NO: 5969 - DNA, 201 bp, Homo sapiens
aatgtccaggccagcagtaccacttctgaactccaacaacgagaaaatgtcagatcccaatatggaagctaacagtcattacggtcacaatgacgatgtcrgaaaccatgcaatgaaaccaataaatgataataaagagcctctgaactcagacgtgcagtacacggaagttcaagtgtcctcagctgagtctcacaaaga

SEQ ID NO: 5970 - DNA, 201 bp, Homo sapiens
ttgggagcaccgcctgtgaaataccaacctgaagacaccgttcattcaggcaacgcacaaaacagaaaatgaaggtggaacaagcacagatgttcttcaamtgtttttgtctacactctttctcttttcctctaccatgctgaaggctgaaagacaggaagatggtgccatcagcaaatattattcttaattgaaaacttg

SEQ ID NO: 5971 - DNA, 201 bp, Homo sapiens
attgccattcccacgccaaaatgttaagtgaggttctgagggtgaaggtgatagccccggtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatc

SEQ ID NO: 5972 - DNA, 201 bp, Homo sapiens
acaaccccactgaagacgtcgaataccagtgtgttgcagataattgccattcccacgccaaaatgttaagtgaggttctgagggtgaaggtgatagccccrgtggatgaggtccagatttctatcctgtcaagtaaggtggtggagtctggagaggacattgtgctgcaatgtgctgtgaatgaaggatctggtcccatca

SEQ ID NO: 5973 - DNA, 201 bp, Homo sapiens
ggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagagtcattctt

SEQ ID NO: 5974 - DNA, 201 bp, Homo sapiens
gagataaagaccttttccatgcaccctcatacacagaaaccaattttcttttttatactcaatcatttctagcgcatggcctggttagaggctggtttttkctcttttcctttggtccttcaaaggcttgtagttttggctagtccttgttctttggaaatacacagtgctgaccagacagcctccccctgtcccctctat

SEQ ID NO: 5975 - DNA, 201 bp, Homo sapiens
cagacagcctccccctgtcccctctatgacctcgccctccacaaatgggaaaaccagactacttgggagcaccgcctgtgaaataccaacctgaagacacsgttcattcaggcaacgcacaaaacagaaaatgaaggtggaacaagcacagatgttcttcaactgtttttgtctacactctttctcttttcctctaccatg

SEQ ID NO: 5976 - DNA, 201 bp, Homo sapiens
ccatctcaaaaaaaacaaaaaacaaaattgcttgctaaagaagtggtctcctgaggtcttaagacattcctgacagtgtcttgagtgggtgggagagaggytgctgtcattgcgctgtggaatttcacagatgagaaccacgcctagccaaaatcacttttcctgtttgcctcagtgacacagctgcagggaccctcgtgg

SEQ ID NO: 5977 - DNA, 201 bp, Homo sapiens
ctctcttgatcattgcggccaaatgttattttctgaggaaagccaaggccaagcagatgccagtggaaatgtccaggccagcagtaccacttctgaactcyaacaacgagaaaatgtcagatcccaatatggaagctaacagtcattacggtcacaatgacgatgtcggaaaccatgcaatgaaaccaataaatgataata

SEQ ID NO: 5978 - DNA, 201 bp, Homo sapiens
ccaattttcttttttatactcaatcatttctagcgcatggcctggttagaggctggttttttctcttttcctttggtccttcaaaggcttgtagttttggstagtccttgttctttggaaatacacagtgctgaccagacagcctccccctgtcccctctatgacctcgccctccacaaatgggaaaaccagactacttgg

SEQ ID NO: 5979 - DNA, 109 bp, Homo sapiens
agatgagaaccacgcctagccaaaatcacttttcctgtttgcctcagtgacacagctgcagggaccctcgtggatgttgtattaaataaatttgacctttrctctttgc

SEQ ID NO: 5980 - DNA, 201 bp, Homo sapiens
aatccatcctgctaagttaatgttgggtagaaagagatacagaggggctgttgaatttcccacataccctccttccaccaagttggaacatccttggaaaytggaagagcacaagaggagatccagggcaaggccattgggatattctgaaacttgaatattttgttttgtgcagagataaagaccttttccatgcaccct

SEQ ID NO: 5981 - DNA, 201 bp, Homo sapiens
aagcagatactctagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatcca

SEQ ID NO: 5982 - DNA, 201 bp, Homo sapiens
tgttctttggaaatacacagtgctgaccagacagcctccccctgtcccctctatgacctcgccctccacaaatgggaaaaccagactacttgggagcacckcctgtgaaataccaacctgaagacaccgttcattcaggcaacgcacaaaacagaaaatgaaggtggaacaagcacagatgttcttcaactgtttttgtct

SEQ ID NO: 5983 - DNA, 201 bp, Homo sapiens
tgggcggatcacctgaggtcaggagtttgagaccagcctgatgaaaccctgtctctactaaaaatacaagaattagccgggcgtggtggcgcatgcctgtrgtatcagctactcaagaggctgaggtgagattatcgcttgaacccaggaaacggaggttgtagtgagcggagatcgcgccactgcactccagcctgagtg

SEQ ID NO: 5984 - DNA, 201 bp, Homo sapiens
gaatccatctcaaaaaaaacaaaaaacaaaattgcttgctaaagaagtggtctcctgaggtcttaagacattcctgacagtgtcttgagtgggtgggagaraggttgctgtcattgcgctgtggaatttcacagatgagaaccacgcctagccaaaatcacttttcctgtttgcctcagtgacacagctgcagggaccctc

SEQ ID NO: 5985 - DNA, 201 bp, Homo sapiens
acacagtccagatagtcgtatgtgaaatgctctcccagcccaggatttcttatgatgcccagtttgaggtcataaaaggacagaccatcgaagtccgttgsgaatcgatcagtggaactttgcctatttcttaccaacttttaaaaacaagtaaagttttggagaatagtaccaagaactcaaatgatcctgcggtattca

SEQ ID NO: 5986 - DNA, 201 bp, Homo sapiens; identical to SEQ ID NO: 5966

SEQ ID NO: 5987 - DNA, 201 bp, Homo sapiens; identical to SEQ ID NO: 5967

SEQ ID NO: 5988 - DNA, 201 bp, Homo sapiens; identical to SEQ ID NO: 5968

SEQ ID NO: 5989 - DNA, 201 bp, Homo sapiens; identical to SEQ ID NO: 5969

SEQ ID NO: 5990 - DNA, 201 bp, Homo sapiens; identical to SEQ ID NO: 5970

SEQ ID NO: 5991 - DNA, 201 bp, Homo sapiens; identical to SEQ ID NO: 5971

SEQ ID NO: 5992 - DNA, 201 bp, Homo sapiens; identical to SEQ ID NO: 5972

SEQ ID NO: 5993 - DNA, 201 bp, Homo sapiens; identical to SEQ ID NO: 5973

SEQ ID NO: 5994 - DNA, 201 bp, Homo sapiens; identical to SEQ ID NO: 5974

SEQ ID NO: 5995 - DNA, 201 bp, Homo sapiens; identical to SEQ ID NO: 5975

SEQ ID NO: 5996 - DNA, 201 bp, Homo sapiens; identical to SEQ ID NO: 5976

SEQ ID NO: 5997 - DNA, 201 bp, Homo sapiens; identical to SEQ ID NO: 5977

SEQ ID NO: 5998 - DNA, 201 bp, Homo sapiens; identical to SEQ ID NO: 5978

SEQ ID NO: 5999 - DNA, 109 bp, Homo sapiens; identical to SEQ ID NO: 5979

SEQ ID NO: 6000 - DNA, 201 bp, Homo sapiens; identical to SEQ ID NO: 5980

SEQ ID NO: 6001 - DNA, 201 bp, Homo sapiens; identical to SEQ ID NO: 5981

SEQ ID NO: 6002 - DNA, 201 bp, Homo sapiens; identical to SEQ ID NO: 5982

SEQ ID NO: 6003 - DNA, 201 bp, Homo sapiens; identical to SEQ ID NO: 5983

SEQ ID NO: 6004 - DNA, 201 bp, Homo sapiens; identical to SEQ ID NO: 5984

SEQ ID NO: 6005 - DNA, 164 bp, Homo sapiens
tttcattttttcaagtggaaccatggaggagagtggctgcccaaggtggggtttgtcttttgcygtctgagtggcccctgggatgcagggcgggtttctcaacggtgacttgtgggcagtgccttctgctgagcgagtcatggcccgaaggcagaactaactgt

SEQ ID NO: 6006 - DNA, 201 bp, Homo sapiens; identical to SEQ ID NO: 5985

SEQ ID NO: 6007 - DNA, 201 bp, Homo sapiens
tttcaagctactcaccctgtaatggatcttaaagcattccccaaagataacatgctttgggtggaatggactactccaagggaatctgtaaagaaatatayacttgagtggtgtgtgttatcagataaagcaccctgtatcacagactggcaacaagaagatggtaccgtgcatcgcacctatttaagagggaacttagca

SEQ ID NO: 6008 - DNA, 201 bp, Homo sapiens
cttggattatgaagtgactctcacaagatggaaatcacatttacaaaattacacagttaatgccacaaaactgacagtaaatctcacaaatgatcgctatstagcaaccctaacagtaagaaatcttgttggcaaatcagatgcagctgttttaactatccctgcctgtgactttcaagctactcaccctgtaatggatct

SEQ ID NO: 6009 - DNA, 201 bp, Homo sapiens
ctgtatcacagactggcaacaagaagatggtaccgtgcatcgcacctatttaagagggaacttagcagagagcaaatgctatttgataacagttactccartatatgctgatggaccaggaagccctgaatccataaaggcataccttaaacaagctccaccttccaaaggacctactgttcggacaaaaaaagtagggaa

SEQ ID NO: 6010 - DNA, 201 bp, Homo sapiens
aaaggacctactgttcggacaaaaaaagtagggaaaaacgaagctgtcttagagtgggaccaacttcctgttgatgttcagaatggatttatcagaaattwtactatattttatagaaccatcattggaaatgaaactgctgtgaatgtggattcttcccacacagaatatacattgtcctctttgactagtgacacattg

SEQ ID NO: 6011 - DNA, 201 bp, Homo sapiens
tgtttatggaatcacaataatttcaggcttgcctccagaaaaacctaaaaatttgagttgcattgtgaacgaggggaagaaaatgaggtgtgagtgggatsgtggaagggaaacacacttggagacaaacttcactttaaaatctgaatgggcaacacacaagtttgctgattgcaaagcaaaacgtgacacccccacctc

SEQ ID NO: 6012 - DNA, 201 bp, Homo sapiens
tcacaataatttcaggcttgcctccagaaaaacctaaaaatttgagttgcattgtgaacgaggggaagaaaatgaggtgtgagtgggatggtggaagggaracacacttggagacaaacttcactttaaaatctgaatgggcaacacacaagtttgctgattgcaaagcaaaacgtgacacccccacctcatgcactgttg

SEQ ID NO: 6013 - DNA, 201 bp, Homo sapiens
ttgtcaacattgaagtctgggtagaagcagagaatgcccttgggaaggttacatcagatcatatcaattttgatcctgtatataaagtgaagcccaatccrccacataatttatcagtgatcaactcagaggaactgtctagtatcttaaaattgacatggaccaacccaagtattaagagtgttataatactaaaatata

SEQ ID NO: 6014 - DNA, 201 bp, Homo sapiens
catttagaagtagaagacttagcttcaaatccctactccttcacttactaattttgtgatttggaaatatccgcgcaagatgttgacgttgcagacttggstagtgcaagccttgtttattttcctcaccactgaatctacaggtgaacttctagatccatgtggttatatcagtcctgaatctccagttgtacaacttca

SEQ ID NO: 6015 - DNA, 201 bp, Homo sapiens
atggcagcatacacagatgaaggtgggaaggatggtccagaattcacttttactaccccaaagtttgtctcatggatccattatggcttcttcacatggcwtgagtcttgccaacgaggaccttacagcttagttgaagaaattttgcataactcaaggagaaattgaagccatagtcgtgcctgtttgcttagcattcct

SEQ ID NO: 6016 - DNA, 201 bp, Homo sapiens; identical to SEQ ID NO: 6007

SEQ ID NO: 6017 - DNA, 201 bp, Homo sapiens; identical to SEQ ID NO: 6008

SEQ ID NO: 6018 - DNA, 201 bp, Homo sapiens
ccgagtctacccagcccttgttagattcagaggagcggccagaagatctacaattagtagatcatgtagatggcggtgatggtattttgcccaggcaacastacttcaaacagaactgcagtcagcatgaatccagtccagatatttcacattttgaaaggtcaaagcaagtttcatcagtcaatgaggaagattttgtta

SEQ ID NO: 6019 - DNA, 201 bp, Homo sapiens; identical to SEQ ID NO: 6009

SEQ ID NO: 6020 - DNA, 201 bp, Homo sapiens; identical to SEQ ID NO: 6010

SEQ ID NO: 6021 - DNA, 201 bp, Homo sapiens; identical to SEQ ID NO: 6013

SEQ ID NO: 6022 - DNA, 201 bp, Homo sapiens; identical to SEQ ID NO: 6014

SEQ ID NO: 6023 - DNA, 201 bp, Homo sapiens
gtattctaccgtggtacacagtggctacagacaccaagttccgtcagtccaagtcttctcaagatccgagtctacccagcccttgttagattcagaggagmggccagaagatctacaattagtagatcatgtagatggcggtgatggtattttgcccaggcaacagtacttcaaacagaactgcagtcagcatgaatccag

SEQ ID NO: 6024 - DNA, 201 bp, Homo sapiens
agaactgcagtcagcatgaatccagtccagatatttcacattttgaaaggtcaaagcaagtttcatcagtcaatgaggaagattttgttagacttaaacarcagatttcagatcatatttcacaatcctgtggatctgggcaaatgaaaatgtttcaggaagtttctgcagcagatgcttttggtccaggtactgagggac

SEQ ID NO: 6025 - DNA, 201 bp, Homo sapiens
agtttcatcagtcaatgaggaagattttgttagacttaaacagcagatttcagatcatatttcacaatcctgtggatctgggcaaatgaaaatgtttcagraagtttctgcagcagatgcttttggtccaggtactgagggacaagtagaaagatttgaaacagttggcatggaggctgcgactgatgaaggcatgcctaa

SEQ ID NO: 6026 - DNA, 201 bp, Homo sapiens; identical to SEQ ID NO: 6011

SEQ ID NO: 6027 - DNA, 201 bp, Homo sapiens
tttccagaagatctgaaatcattggacctgttcaaaaaggaaaaaattaatactgaaggacacagcagtggtattggggggtcttcatgcatgtcatcttytaggccaagcatttctagcagtgatgaaaatgaatcttcacaaaacacttcgagcactgtccagtattctaccgtggtacacagtggctacagacaccaa

SEQ ID NO: 6028 - DNA, 201 bp, Homo sapiens; identical to SEQ ID NO: 6012

SEQ ID NO: 6029 - DNA, 201 bp, Homo sapiens; identical to SEQ ID NO: 6007

SEQ ID NO: 6030 - DNA, 201 bp, Homo sapiens; identical to SEQ ID NO: 6008

SEQ ID NO: 6031 - DNA, 201 bp, Homo sapiens; identical to SEQ ID NO: 6018

SEQ ID NO: 6032 - DNA, 201 bp, Homo sapiens; identical to SEQ ID NO: 6009

SEQ ID NO: 6033 - DNA, 201 bp, Homo sapiens; identical to SEQ ID NO: 6010

SEQ ID NO: 6034 - DNA, 201 bp, Homo sapiens; identical to SEQ ID NO: 6023

SEQ ID NO: 6035 - DNA, 201 bp, Homo sapiens; identical to SEQ ID NO: 6013

SEQ ID NO: 6036 - DNA, 201 bp, Homo sapiens; identical to SEQ ID NO: 6014

SEQ ID NO: 6037 - DNA, 201 bp, Homo sapiens; identical to SEQ ID NO: 6024

SEQ ID NO: 6038 - DNA, 201 bp, Homo sapiens; identical to SEQ ID NO: 6025

SEQ ID NO: 6039 - DNA, 201 bp, Homo sapiens; identical to SEQ ID NO: 6011

SEQ ID NO: 6040 - DNA, 201 bp, Homo sapiens; identical to SEQ ID NO: 6027

SEQ ID NO: 6041 - DNA, 201 bp, Homo sapiens; identical to SEQ ID NO: 6012

SEQ ID NO: 6042 - DNA, 201 bp, Homo sapiens
cccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagg

SEQ ID NO: 6043 - DNA, 201 bp, Homo sapiens
atggaaggcatcctgtggtatttaggtggcatgacattgccaacatgtcccacaacaagtccttttttgcattagagctggcaaataaagaggagaccatycaatttcaaactgaagacatggaaacagcaaaatacatttggagactctgtgttgcgcgacacaagttttacagactaaaccagtgtaacctgcaaactc

SEQ ID NO: 6044 - DNA, 201 bp, Homo sapiens
acggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggcccctgcacatcctggagcccaagg

SEQ ID NO: 6045 - DNA, 201 bp, Homo sapiens
acaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatcatatcttgaagagatcc

SEQ ID NO: 6046 - DNA, 201 bp, Homo sapiens
tacagaaccatatgcttcttcccaagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaa

SEQ ID NO: 6047 - DNA, 201 bp, Homo sapiens
ccctacccgccccccaggcccgccaacagcacgccagacctgtcccgccacctttacatcagcagcagcaaccccgacctcatcacgcggcgcgtgcaccwctcggtgcaaacgttccaggaggacagcctgcccgtggcgcactcgctgcaggaggtcagcgagcccctcaccgccgcgcgccacgcgcagctgcacaaa

SEQ ID NO: 6048 - DNA, 201 bp, Homo sapiens
tcaatgctcccttcctcgggccattggagactccgttgctttttaatggcggcagcggctgctgggtgagcagctggaggccggacagtgttcgtcccatmcggagaggatcgctttctcctggcgtcaccagcgctgggttggtgggggtagcttttccctctttgctcctccattcttgaagaaagaagaagatgccac

SEQ ID NO: 6049 - DNA, 201 bp, Homo sapiens
aagtggctaccagagcaacgaatgatgaaaggtgtaaaattctggaacaacgattagaacaaggaatggtattcacagaatatgaaagaattcttaagaamcggctagttgatggggagtgctcaacagcacgactccctgaaaatgcagaaagaaatcgattccaagatgttcttccttatgatgatgtgagagtggagt

SEQ ID NO: 6050 - DNA, 201 bp, Homo sapiens
gccagtacacatttgtgtacagagtcctcatccagttcctgaaaagctccaggctcatctaagctcccacaatttcttacggggccagtcatgtgaagcgwttacagcttaaaaaaaaagcgcttgcctaactcatactttcccgttgacacttgatccacgcagcgtggcactgggacgtaagtggcgcagtctgaatgg

SEQ ID NO: 6051 - DNA, 201 bp, Homo sapiens
aggaagtggctaccagagcaacgaatgatgaaaggtgtaaaattctggaacaacgattagaacaaggaatggtattcacagaatatgaaagaattcttaaraaacggctagttgatggggagtgctcaacagcacgactccctgaaaatgcagaaagaaatcgattccaagatgttcttccttatgatgatgtgagagtgg

SEQ ID NO: 6052 - DNA, 201 bp, Homo sapiens
agcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggagg

SEQ ID NO: 6053 - DNA, 201 bp, Homo sapiens
agtgcctctgcctgatgaaggaaaggaagtggctaccagagcaacgaatgatgaaaggtgtaaaattctggaacaacgattagaacaaggaatggtattcmcagaatatgaaagaattcttaagaaacggctagttgatggggagtgctcaacagcacgactccctgaaaatgcagaaagaaatcgattccaagatgttct

SEQ ID NO: 6054 - DNA, 201 bp, Homo sapiens
gtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagt

SEQ ID NO: 6055 - DNA, 201 bp, Homo sapiens
catcctggagcccaaggcccacgtcccagacgcggagaagaggatgatggacagcagccccgtccgcacgaccgcagaggcccagcggccctggagagacsggctgctgatgccctccatgtcggagtccgacctcaccacgtcaggccgctaccgagcccggagggactctctgaagaaaaggccggtgtcggaccttct

SEQ ID NO: 6056 - DNA, 201 bp, Homo sapiens
ctgaaaatgcagaaagaaatcgattccaagatgttcttccttatgatgatgtgagagtggagttggtcccaactaaagaaaacaacactggttacatcaaygcatcacatattaaggtctctgtcagtggaatcgaatgggattatattgccacacagggaccattacagaatacctgtcaagatttttggcagatggtat

SEQ ID NO: 6057 - DNA, 201 bp, Homo sapiens
aggagagcggggcccgggcgcctcctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctgga

SEQ ID NO: 6058 - DNA, 201 bp, Homo sapiens
aagctccaggctcatctaagctcccacaatttcttacggggccagtcatgtgaagcgtttacagcttaaaaaaaaagcgcttgcctaactcatactttccygttgacacttgatccacgcagcgtggcactgggacgtaagtggcgcagtctgaatggcggcacgctgaaggaaacgtgcgaagcacaggctgaagagggg

SEQ ID NO: 6059 - DNA, 201 bp, Homo sapiens
attcttaagaaacggctagttgatggggagtgctcaacagcacgactccctgaaaatgcagaaagaaatcgattccaagatgttcttccttatgatgatgygagagtggagttggtcccaactaaagaaaacaacactggttacatcaacgcatcacatattaaggtctctgtcagtggaatcgaatgggattatattgcc

SEQ ID NO: 6060 - DNA, 201 bp, Homo sapiens
ctttacaaaaatgcagtattatctatactcagactgaggtgctgggatggcgagcaggggaccccacagcactgtccccagggaattcaagtcctgtgacygccagtgacttactccgtttccttggggcttttcccacctcaacctgtattgtttctttttcataaataaattcagcattatagtatcattaaaagaagc

SEQ ID NO: 6061 - DNA, 201 bp, Homo sapiens
atagcacaagtgatccccaaagccccaaccctccgttgttggtccactgcagtgctggggtaggaaggactggcgtggtgattttgtcggagatcatgatygcctgcctggaacacaatgaggtgctggacatcccgagagtgctggacatgctgaggcaacagagaatgatgctggtgcagactctctgccagtacacat

SEQ ID NO: 6062 - DNA, 196 bp, Homo sapiens
gccccatgagcgcgccgcggcccgggctggcgtgcgggtgcggctgcggcggccgcgcggcggggccccgggaggcgggtcgctgagcggggcgckcggccccgaggatgcgggagcgggagcgggagcagcgctggcgtcaatgctcccttcctcgggccattggagactccgttgctttttaatggcggcagcg

SEQ ID NO: 6063 - DNA, 201 bp, Homo sapiens
cctgaacatggctgtccagaagacctcaagggatttttatcatatcttgaagagatccagtctgttcgacgccatacaaatagcacaagtgatccccaaarccccaaccctccgttgttggtccactgcagtgctggggtaggaaggactggcgtggtgattttgtcggagatcatgatcgcctgcctggaacacaatgag

SEQ ID NO: 6064 - DNA, 201 bp, Homo sapiens; identical to SEQ ID NO: 6052

SEQ ID NO: 6065 - DNA, 201 bp, Homo sapiens; identical to SEQ ID NO: 6055

SEQ ID NO: 6066 - DNA, 201 bp, Homo sapiens; identical to SEQ ID NO: 6042

SEQ ID NO: 6067 - DNA, 201 bp, Homo sapiens; identical to SEQ ID NO: 6057

SEQ ID NO: 6068 - DNA, 201 bp, Homo sapiens; identical to SEQ ID NO: 6044

SEQ ID NO: 6069 - DNA, 201 bp, Homo sapiens; identical to SEQ ID NO: 6043

SEQ ID NO: 6070 - DNA, 201 bp, Homo sapiens; identical to SEQ ID NO: 6047

SEQ ID NO: 6071 - DNA, 201 bp, Homo sapiens; identical to SEQ ID NO: 6046

SEQ ID NO: 6072 - DNA, 201 bp, Homo sapiens; identical to SEQ ID NO: 6048

SEQ ID NO: 6073 - DNA, 201 bp, Homo sapiens
ccagaaacatatctcaagatatgacacagacatcaggtacaaatcttacttcagaagagcttcggaagagacgagaagcctactttgaaaaacagcagcaraagcagcaacagcagcagcagcagcagcagcagggggacctatcaggacagagttcacatccatgtgaaaggccagccaccagttcaggagcacttggga

SEQ ID NO: 6074 - DNA, 132 bp, Homo sapiens
gcagggggcggagctggagggggtggttcggygtgggggccgttggctccagacaaataaacatggagtccatcttccacgagaaacaagaaggctcactttgtgctcaacattgcctgaataacttattgc

SEQ ID NO: 6075 - DNA, 201 bp, Homo sapiens
aggtacaaatcttacttcagaagagcttcggaagagacgagaagcctactttgaaaaacagcagcaaaagcagcaacagcagcagcagcagcagcagcagsgggacctatcaggacagagttcacatccatgtgaaaggccagccaccagttcaggagcacttgggagtgatctaggtaaggcctgctcaccattcatcat

SEQ ID NO: 6076 - DNA, 201 bp, Homo sapiens
tatctcaagatatgacacagacatcaggtacaaatcttacttcagaagagcttcggaagagacgagaagcctactttgaaaaacagcagcaaaagcagcarcagcagcagcagcagcagcagcagggggacctatcaggacagagttcacatccatgtgaaaggccagccaccagttcaggagcacttgggagtgatctag

SEQ ID NO: 6077 - DNA, 201 bp, Homo sapiens
gcagatgattagggtccaacagatgcatcgaccaaaacttattggagaagaattagcacaactaaaagagcaaagagtccataaaacagacctggaacgartgttagaagcaaatgatggctcaggaatgttagacgaagatgaggaggatttgcagagggctctggcactaagtcgccaagaaattgacatggaagatga

SEQ ID NO: 6078 - DNA, 146 bp, Homo sapiens
gtgaaaggccagccaccagttcaggagcacttgggagtgatctaggtaaggcctgctcaccattcatcatgttcgctaccttcacactttatctgacatamgagctccatgtgatttttgctttacattattcttcattccctctt

SEQ ID NO: 6079 - DNA, 201 bp, Homo sapiens
cagaaacatatctcaagatatgacacagacatcaggtacaaatcttacttcagaagagcttcggaagagacgagaagcctactttgaaaaacagcagcaamagcagcaacagcagcagcagcagcagcagcagggggacctatcaggacagagttcacatccatgtgaaaggccagccaccagttcaggagcacttgggag

SEQ ID NO: 6080 - DNA, 201 bp, Homo sapiens
gttagggcatttttcttggatctttttgcagactagctaattagctctcgcctcaggctttttccatatagtttgttttctttttctgtcttgtaggtaakttggctcacatcatgtaatagtggctttcatttcttattaaccaaattaacctttcaggaaagtatctctactttcctgatgttgataatagtaatggtt

SEQ ID NO: 6081 - DNA, 201 bp, Homo sapiens
acacagacatcaggtacaaatcttacttcagaagagcttcggaagagacgagaagcctactttgaaaaagcagcaacagcagcagcagcagcagcagcagsgggacctatcaggacagagttcacatccatgtgaaaggccagccaccagttcaggagcacttgggagtgatctaggtgatgctatgagtgaagaagacat

SEQ ID NO: 6082 - DNA, 201 bp, Homo sapiens
ttacagcatagggtccactttggtaatgtgtcaaagagatgaggaaataagacttttagcggtttgcaaacaaaatgatgggaaagtggaacaatgcgtckgttgtaggactaaataatgatcttccaaatattagccaaagaggcattcagcaattaaagacatttaaaatagttttctaaatgtttctttttctttttt

SEQ ID NO: 6083 - DNA, 201 bp, Homo sapiens; identical to SEQ ID NO: 6077

SEQ ID NO: 6084 - DNA, 201 bp, Homo sapiens
ttccagaaacatatctcaagatatgacacagacatcaggtacaaatcttacttcagaagagcttcggaagagacgagaagcctactttgaaaaagcagcarcagcagcagcagcagcagcagcagggggacctatcaggacagagttcacatccatgtgaaaggccagccaccagttcaggagcacttgggagtgatctag

SEQ ID NO: 6085 - DNA, 201 bp, Homo sapiens
aaggtagttccagaaacatatctcaagatatgacacagacatcaggtacaaatcttacttcagaagagcttcggaagagacgagaagcctactttgaaaamgcagcaacagcagcagcagcagcagcagcagggggacctatcaggacagagttcacatccatgtgaaaggccagccaccagttcaggagcacttgggagt

SEQ ID NO: 6086 - DNA, 201 bp, Homo sapiens
aaggtagttccagaaacatatctcaagatatgacacagacatcaggtacaaatcttacttcagaagagcttcggaagagacgagaagcctactttgaaaargcagcaacagcagcagcagcagcagcagcagggggacctatcaggacagagttcacatccatgtgaaaggccagccaccagttcaggagcacttgggagt

SEQ ID NO: 6087 - DNA, 201 bp, Homo sapiens
tgattacagcatagggtccactttggtaatgtgtcaaagagatgaggaaataagacttttagcggtttgcaaacaaaatgatgggaaagtggaacaatgcrtcggttgtaggactaaataatgatcttccaaatattagccaaagaggcattcagcaattaaagacatttaaaatagttttctaaatgtttctttttcttt

SEQ ID NO: 6088 - DNA, 132 bp, Homo sapiens; identical to SEQ ID NO: 6074

SEQ ID NO: 6089 - DNA, 201 bp, Homo sapiens
ataatttagatattcatactttccaacattatcctgtgtgattacagcatagggtccactttggtaatgtgtcaaagagatgaggaaataagacttttagmggtttgcaaacaaaatgatgggaaagtggaacaatgcgtcggttgtaggactaaataatgatcttccaaatattagccaaagaggcattcagcaattaaa

SEQ ID NO: 6090 - DNA, 201 bp, Homo sapiens; identical to SEQ ID NO: 6080

SEQ ID NO: 6091 - DNA, 201 bp, Homo sapiens
aggtacaaatcttacttcagaagagcttcggaagagacgagaagcctactttgaaaaacagcagcaaaagcagcaacagcagcagcagcagcagcagcagsgggacctatcaggacagagttcacatccatgtgaaaggccagccaccagttcaggagcacttgggagtgatctaggtgatgctatgagtgaagaagacat

SEQ ID NO: 6092 - DNA, 201 bp, Homo sapiens; identical to SEQ ID NO: 6082

SEQ ID NO: 6093 - DNA, 201 bp, Homo sapiens; identical to SEQ ID NO: 6076

SEQ ID NO: 6094 - DNA, 201 bp, Homo sapiens; identical to SEQ ID NO: 6077

SEQ ID NO: 6095 - DNA, 201 bp, Homo sapiens; identical to SEQ ID NO: 6079

SEQ ID NO: 6096 - DNA, 201 bp, Homo sapiens; identical to SEQ ID NO: 6073

SEQ ID NO: 6097 - DNA, 132 bp, Homo sapiens; identical to SEQ ID NO: 6074

SEQ ID NO: 6098 - DNA, 201 bp, Homo sapiens; identical to SEQ ID NO: 6087

SEQ ID NO: 6099 - DNA, 201 bp, Homo sapiens; identical to SEQ ID NO: 6089

SEQ ID NO: 6100 - DNA, 201 bp, Homo sapiens; identical to SEQ ID NO: 6080

SEQ ID NO: 6101 - DNA, 201 bp, Homo sapiens; identical to SEQ ID NO: 6091

SEQ ID NO: 6102 - DNA, 201 bp, Homo sapiens; identical to SEQ ID NO: 6082

SEQ ID NO: 6103 - DNA, 201 bp, Homo sapiens; identical to SEQ ID NO: 6076

SEQ ID NO: 6104 - DNA, 201 bp, Homo sapiens; identical to SEQ ID NO: 6077

SEQ ID NO: 6105 - DNA, 201 bp, Homo sapiens; identical to SEQ ID NO: 6079

SEQ ID NO: 6106 - DNA, 201 bp, Homo sapiens; identical to SEQ ID NO: 6073

SEQ ID NO: 6107 - DNA, 128 bp, Homo sapiens
ggggcggagctggagggggtggttcggygtgggggccgttggctccagacaaataaacatggagtccatcttccacgagaaacagccttctggaaatatggatgacagtggttttttctctattcagg

SEQ ID NO: 6108 - DNA, 201 bp, Homo sapiens; identical to SEQ ID NO: 6087

SEQ ID NO: 6109 - DNA, 201 bp, Homo sapiens; identical to SEQ ID NO: 6089

SEQ ID NO: 6110 - DNA, 201 bp, Homo sapiens
ccaggtgcctggcagtggcatggcagcactgggtggatgcccaaggggcagagcagctggtgcggaccctgccagccttccagaagtctgtgccacagccrcgcaccgtggagctttccctgcttgccagccccggggccccttcgttttcaggggaggggggaacggggcagcatcaggcctccacagccaggcaaaagg

SEQ ID NO: 6111 - DNA, 201 bp, Homo sapiens
ctaggaggtggaagggtacagcactttgccacatctcttctacgatgccaccagtgcctgatgcccttgcgtgttttgcctgtactgcacgggctccaagkgtaagttcactgggagtcccaggctggctctggaggctgccttggttcgagggcttagttggcaacaaccactctcctcgccttctcaggaggtgccacc

SEQ ID NO: 6112 - DNA, 201 bp, Homo sapiens
ttctataaattgagcccgcagcctcccgcttcgctctctgctcctcctgttcgacagtcagccgcatcttcttttgcgtcgccagccgagccacatcgctsagacaccatggggaaggtgaaggtcggagtcaacggatttggtcgtattgggcgcctggtcaccagggctgcttttaactctggtaaagtggatattgtt

SEQ ID NO: 6113 - DNA, 201 bp, Homo sapiens
ctcctccacctttgacgctggggctggcattgccctcaacgaccactttgtcaagctcatttcctggtatgacaacgaatttggctacagcaacagggtgrtggacctcatggcccacatggcctccaaggagtaagacccctggaccaccagccccagcaagagcacaagaggaagagagagaccctcactgctggggag

SEQ ID NO: 6114 - DNA, 201 bp, Homo sapiens
gcaaggtcatccctgagctgaacgggaagctcactggcatggccttccgtgtccccactgccaacgtgtcagtggtggacctgacctgccgtctagaaaamcctgccaaatatgatgacatcaagaaggtggtgaagcaggcgtcggagggccccctcaagggcatcctgggctacactgagcaccaggtggtctcctctg

SEQ ID NO: 6115 - DNA, 201 bp, Homo sapiens
accactttgtcaagctcatttcctggtatgacaacgaatttggctacagcaacagggtggtggacctcatggcccacatggcctccaaggagtaagacccytggaccaccagccccagcaagagcacaagaggaagagagagaccctcactgctggggagtccctgccacactcagtcccccaccacactgaatctcccct

SEQ ID NO: 6116 - DNA, 201 bp, Homo sapiens
gtcagtggtggacctgacctgccgtctagaaaaacctgccaaatatgatgacatcaagaaggtggtgaagcaggcgtcggagggccccctcaagggcatcytgggctacactgagcaccaggtggtctcctctgacttcaacagcgacacccactcctccacctttgacgctggggctggcattgccctcaacgaccactt

SEQ ID NO: 6117 - DNA, 170 bp, Homo sapiens
aggaagagagagaccctcactgctggggagtccctgccacactcagtcccccaccacactgaatctcccctcctcacagttgccatgtagaccccttgaaraggggaggggcctagggagccgcaccttgtcatgtaccatcaataaagtaccctgtgctcaaccagtta

SEQ ID NO: 6118 - DNA, 201 bp, Homo sapiens
gtggtgaagcaggcgtcggagggccccctcaagggcatcctgggctacactgagcaccaggtggtctcctctgacttcaacagcgacacccactcctccayctttgacgctggggctggcattgccctcaacgaccactttgtcaagctcatttcctggtatgacaacgaatttggctacagcaacagggtggtggacctc

SEQ ID NO: 6119 - DNA, 201 bp, Homo sapiens
ttgacgctggggctggcattgccctcaacgaccactttgtcaagctcatttcctggtatgacaacgaatttggctacagcaacagggtggtggacctcatkgcccacatggcctccaaggagtaagacccctggaccaccagccccagcaagagcacaagaggaagagagagaccctcactgctggggagtccctgccaca

SEQ ID NO: 6120 - DNA, 201 bp, Homo sapiens
tgaagcaggcgtcggagggccccctcaagggcatcctgggctacactgagcaccaggtggtctcctctgacttcaacagcgacacccactcctccaccttygacgctggggctggcattgccctcaacgaccactttgtcaagctcatttcctggtatgacaacgaatttggctacagcaacagggtggtggacctcatgg

SEQ ID NO: 6121 - DNA, 201 bp, Homo sapiens
acgtcgtggagtccactggcgtcttcaccaccatggagaaggctggggctcatttgcaggggggagccaaaagggtcatcatctctgccccctctgctgaygcccccatgttcgtcatgggtgtgaaccatgagaagtatgacaacagcctcaagatcatcagcaatgcctcctgcaccaccaactgcttagcacccctgg

SEQ ID NO: 6122 - DNA, 146 bp, Homo sapiens
ggggagtccctgccacactcagtcccccaccacactgaatctcccctcctcacagttgccatgtagaccccttgaagaggggaggggcctagggagccgcmccttgtcatgtaccatcaataaagtaccctgtgctcaaccagtta

SEQ ID NO: 6123 - DNA, 189 bp, Homo sapiens
gccccagcaagagcacaagaggaagagagagaccctcactgctggggagtccctgccacactcagtcccccaccacactgaatctcccctcctcacagttkccatgtagaccccttgaagaggggaggggcctagggagccgcaccttgtcatgtaccatcaataaagtaccctgtgctcaaccagtta

SEQ ID NO: 6124 - DNA, 201 bp, Homo sapiens
cgtgtcagtggtggacctgacctgccgtctagaaaaacctgccaaatatgatgacatcaagaaggtggtgaagcaggcgtcggagggccccctcaagggcrtcctgggctacactgagcaccaggtggtctcctctgacttcaacagcgacacccactcctccacctttgacgctggggctggcattgccctcaacgacca

SEQ ID NO: 6125 - DNA, 201 bp, Homo sapiens
cactgccaacgtgtcagtggtggacctgacctgccgtctagaaaaacctgccaaatatgatgacatcaagaaggtggtgaagcaggcgtcggagggccccytcaagggcatcctgggctacactgagcaccaggtggtctcctctgacttcaacagcgacacccactcctccacctttgacgctggggctggcattgccct

SEQ ID NO: 6126 - DNA, 201 bp, Homo sapiens
acctgccaaatatgatgacatcaagaaggtggtgaagcaggcgtcggagggccccctcaagggcatcctgggctacactgagcaccaggtggtctcctctkacttcaacagcgacacccactcctccacctttgacgctggggctggcattgccctcaacgaccactttgtcaagctcatttcctggtatgacaacgaatt

SEQ ID NO: 6127 - DNA, 201 bp, Homo sapiens
atgtgaatttccacaccaaacagagcatgaggaaccagttgacatgctgggttgtgactggcagctttagcagcctcggtactgaagccacaccagtgtcmggatggaagtctgcatctgaggttgctcagtgtcccggtcattcatttacacattttaacttgcattaaagagctgttcttttctgtggcctagactctt

SEQ ID NO: 6128 - DNA, 201 bp, Homo sapiens
ttgcttcctcagtgtcagggcacatgtgaatttccacaccaaacagagcatgaggaaccagttgacatgctgggttgtgactggcagctttagcagcctcrgtactgaagccacaccagtgtccggatggaagtctgcatctgaggttgctcagtgtcccggtcattcatttacacattttaacttgcattaaagagctgt

SEQ ID NO: 6129 - DNA, 201 bp, Homo sapiens
tcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaactt

SEQ ID NO: 6130 - DNA, 201 bp, Homo sapiens
tggaaagttcaatccacacgtccacgtagaatatgagtggaatcttcgacaggaggagatagatgagagcgatgatgatctggatgacaaaccaagccctrtcaagaaagagcgctcacccagacctcagagcttctgccactcctccagcatctccccccaggacaagctggcactgccaggattcagcactccaaggga

SEQ ID NO: 6131 - DNA, 201 bp, Homo sapiens
gaaggacagcctgaaaggaagggggtctttccagtgtcctttgttcatatcctgtctgactagcaaaacgcagaaccttaagattgtccacatccttcatscaagactgctgccttcatgtaaccctgggcacagtgtgtatatagctgctgttacagagtaagaaactcatggaagggccacctcaggagggggatataa

SEQ ID NO: 6132 - DNA, 201 bp, Homo sapiens
aaggacagcctgaaaggaagggggtctttccagtgtcctttgttcatatcctgtctgactagcaaaacgcagaaccttaagattgtccacatccttcatgmaagactgctgccttcatgtaaccctgggcacagtgtgtatatagctgctgttacagagtaagaaactcatggaagggccacctcaggagggggatataat

SEQ ID NO: 6133 - DNA, 201 bp, Homo sapiens
ctggagaaactgccctagacatagcaaagagactaaaagctacccagtgtgaagatctgctttcccaggctaaatctggaaagttcaatccacacgtccaygtagaatatgagtggaatcttcgacaggaggagatagatgagagcgatgatgatctggatgacaaaccaagccctatcaagaaagagcgctcacccagac

SEQ ID NO: 6134 - DNA, 201 bp, Homo sapiens
attctggtcaagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctgctccagggtttgagccacaatgtgatcttcaccttggattctt

SEQ ID NO: 6135 - DNA, 201 bp, Homo sapiens
tgaaaggaagggggtctttccagtgtcctttgttcatatcctgtctgactagcaaaacgcagaaccttaagattgtccacatccttcatgcaagactgctkccttcatgtaaccctgggcacagtgtgtatatagctgctgttacagagtaagaaactcatggaagggccacctcaggagggggatataatgtgtgttgta

SEQ ID NO: 6136 - DNA, 201 bp, Homo sapiens
atccttcatgcaagactgctgccttcatgtaaccctgggcacagtgtgtatatagctgctgttacagagtaagaaactcatggaagggccacctcaggagsgggatataatgtgtgttgtaaatatcctgtggttttctgccttcaccagtatgagggtagcctcggacccggcgcgccttactggtttgccaaagccatc

SEQ ID NO: 6137 - DNA, 201 bp, Homo sapiens
gtggtggattggccacatcgaaggacagcctgaaaggaagggggtctttccagtgtcctttgttcatatcctgtctgactagcaaaacgcagaaccttaakattgtccacatccttcatgcaagactgctgccttcatgtaaccctgggcacagtgtgtatatagctgctgttacagagtaagaaactcatggaagggcca

SEQ ID NO: 6138 - DNA, 201 bp, Homo sapiens; identical to SEQ ID NO: 6127

SEQ ID NO: 6139 - DNA, 201 bp, Homo sapiens; identical to SEQ ID NO: 6128

SEQ ID NO: 6140 - DNA, 201 bp, Homo sapiens; identical to SEQ ID NO: 6129

SEQ ID NO: 6141 - DNA, 201 bp, Homo sapiens; identical to SEQ ID NO: 6130

SEQ ID NO: 6142 - DNA, 201 bp, Homo sapiens; identical to SEQ ID NO: 6131

SEQ ID NO: 6143 - DNA, 201 bp, Homo sapiens; identical to SEQ ID NO: 6132

SEQ ID NO: 6144 - DNA, 201 bp, Homo sapiens; identical to SEQ ID NO: 6133

SEQ ID NO: 6145 - DNA, 201 bp, Homo sapiens; identical to SEQ ID NO: 6134

SEQ ID NO: 6146 - DNA, 201 bp, Homo sapiens; identical to SEQ ID NO: 6135

SEQ ID NO: 6147 - DNA, 201 bp, Homo sapiens; identical to SEQ ID NO: 6136

SEQ ID NO: 6148 - DNA, 201 bp, Homo sapiens; identical to SEQ ID NO: 6137

SEQ ID NO: 6149 - DNA, 176 bp, Homo sapiens
atggggccacttaccagcttccgaagggctccctcatccagcccagctaaggcctcgtccgccatctcgctggccyctagctccgtcggttcctttctggtgagatccccagtgcctgtggcacctgtcaccagctcagagaattctgcaggggacagacatgaatcaggcatgct

SEQ ID NO: 6150 - DNA, 147 bp, Homo sapiens
ccggcctaatttttctgactgatatggaaacgattgccaacacatacttctacttttaaataaacaactttgatgatgtaacttgaccttccagagttatrgaaattttgtccccatgtaatgaataaattgtatgtatttttctct

SEQ ID NO: 6151 - DNA, 201 bp, Homo sapiens
ttggatatatttacaggctggctcaggactatctgcagtgcgtcctacagataccacaacctggatcaggtccaagcaaaacgtccagagtgctacaaaakgttgcgttctcagtccaaaaagaagtggaaaagaatctgaagtcatgcttggacaatgttaatgttgtgtccgtagacactgccagaacactattcaacc

SEQ ID NO: 6152 - DNA, 201 bp, Homo sapiens
ttaactggggaagaattgtaaccatatttgcatttgaaggtattctcatcaagaaacttctacgacagcaaattgccccggatgtggatacctataaggakatttcatattttgttgcggagttcataatgaataacacaggagaatggataaggcaaaacggaggctgggaaaatggctttgtaaagaagtttgaaccta

SEQ ID NO: 6153 - DNA, 201 bp, Homo sapiens
agatgacagactgtgaatttggatatatttacaggctggctcaggactatctgcagtgcgtcctacagataccacaacctggatcaggtccaagcaaaacrtccagagtgctacaaaatgttgcgttctcagtccaaaaagaagtggaaaagaatctgaagtcatgcttggacaatgttaatgttgtgtccgtagacactg

SEQ ID NO: 6154 - DNA, 201 bp, Homo sapiens
ggcaaaacggaggctgggaaaatggctttgtaaagaagtttgaacctaaatctggctggatgacttttctagaagttacaggaaagatctgtgaaatgctmtctctcctgaagcaatactgttgaccagaaaggacactccatattgtgaaaccggcctaatttttctgactgatatggaaacgattgccaacacatactt

SEQ ID NO: 6155 - DNA, 201 bp, Homo sapiens
gaaaagaatctgaagtcatgcttggacaatgttaatgttgtgtccgtagacactgccagaacactattcaaccaagtgatggaaaaggagtttgaagacgrcatcattaactggggaagaattgtaaccatatttgcatttgaaggtattctcatcaagaaacttctacgacagcaaattgccccggatgtggatacctat

SEQ ID NO: 6156 - DNA, 201 bp, Homo sapiens
ttcaaggtgagccagctcaagactttgctctccaccaggcagaagatgacagactgtgaatttggatatatttacaggctggctcaggactatctgcagtrcgtcctacagataccacaacctggatcaggtccaagcaaaacgtccagagtgctacaaaatgttgcgttctcagtccaaaaagaagtggaaaagaatctg

SEQ ID NO: 6157 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacagatcgccatgggcgtgccactgcaccggctgaaggatatccggcttctgtatggagagtcaccatggggagtga

SEQ ID NO: 6158 - DNA, 201 bp, Homo sapiens
atttttgtatttttggtagagacagagtttcaccaggttggtcaggctggtctcaaactcttgacttcaggtaatccacccaccttggcctcccaaagtgmtgggattacaggcatgagccaccatcttcagccagatgatttttttattgagagagtgaaatgctattttgttccccaaatggcgctagtgaatcactag

SEQ ID NO: 6159 - DNA, 201 bp, Homo sapiens
aatgagtcgggctactacctggacatcagcctctacaaagaagtgactgactccagatctggaaatatcatgtttcactccttcggcaacaagcaagggcsccagcacgggatgctgatcaatactccctacgtcaccaaggatctgctccaggccaagcgattccaggcccagaccctgggaaccacctacatctatgac

SEQ ID NO: 6160 - DNA, 201 bp, Homo sapiens
ccaggtcctcccagcggattcactactgaacctcgtagatgtggaattaatttacggaggtgttaagtacattctcaaggtggcccggcagtctctgaccrtgttcgttctcatcatgaatggctgccacatcgagattgatgcccaccggctgaatgatggggggctcctgctctcctacaatgggaacagctacaccac

SEQ ID NO: 6161 - DNA, 201 bp, Homo sapiens
tcgcgactgctccatccagcggcggcatcagaagatcgttgaggaagcaccggccaccatcgccccgctggccatattcgagttcatggagcagtgtgccrtccgcctggccaagaccgtgggctatgtgagtgcagggacagtggaatacctctatagtcaggatggcagcttccacttcttggagctgaatcctcgctt

SEQ ID NO: 6162 - DNA, 201 bp, Homo sapiens
ttgcggattcccaatttgggcactgcttctcctggggagagaaccgggaagaggccatttcgaacatggtggtggctttgaaggaactgtccatccgaggygactttaggactaccgtggaatacctcattaacctcctggagaccgagagcttccagaacaacgacatcgacaccgggtggttggactacctcattgctg

SEQ ID NO: 6163 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgagggttttaagccgagctccgggactgtccaggaactgaatttccggagcagcaagaacgtgtggggttactt

SEQ ID NO: 6164 - DNA, 201 bp, Homo sapiens
agtccctgcagaccctgccaacctggattctgaggccaagataattcagcaggcaggacaggtgtggttcccagactcagcctacaaaaccgcccaggccrtcaaggacttcaaccgggagaagttgcccctgatgatctttgccaactggagggggttctccggtggcatgaaagacatgtatgaccaggtgctgaagtt

SEQ ID NO: 6165 - DNA, 201 bp, Homo sapiens
agcaagctggctccccctccaaagaagacaagaagcaggcaaacatcaagaggcagctgatgaccaacttcatcctgggctcttttgatgactactcctcygacgaggactctgttgctggctcatctcgtgagtctacccggaagggcagccgggccagcttgggggccctgtccctggaggcttatctgaccacaggtg

SEQ ID NO: 6166 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggctct

SEQ ID NO: 6167 - DNA, 119 bp, Homo sapiens
atggtcttgcttctttgtytatcttgtctgattttctcctgtctgaccttttcctggttaaaaatctgggggaaaatgacggactccaagccgatcaccaagagtaaatcagaagcaaa

SEQ ID NO: 6168 - DNA, 201 bp, Homo sapiens
atcaccgtgccagatgactttgagggggtttataccatcctggagtggctgtcctatatgccaaaggataatcacagccctgtccctatcatcacacccaytgaccccattgacagagaaattgaattcctcccatccagagctccctacgacccccggtggatgcttgcaggaaggcctcacccaactctgaagggaacg

SEQ ID NO: 6169 - DNA, 201 bp, Homo sapiens
aagaatttcccaagtttttcacattcagagcaagagatgagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtga

SEQ ID NO: 6170 - DNA, 201 bp, Homo sapiens
cccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcagtgtgccatccgcctggccaagaccgtgggctatgtgagtgcaggga

SEQ ID NO: 6171 - DNA, 201 bp, Homo sapiens
cctgcacagaaatgattgctgacgttaatctgccggccgcccagctacagatcgccatgggcgtgccactgcaccggctgaaggatatccggcttctgtayggagagtcaccatggggagtgactcccatttcttttgaaaccccctcaaaccctcccctcgcccgaggccacgtcattgccgccagaatcaccagcgaaa

SEQ ID NO: 6172 - DNA, 201 bp, Homo sapiens
ccatgccgatttgctcagggagaacgttgcaatgcacccagcagctcctggctctgcaggcggcacagcctggggccctgtgatcctctggtttcttccaytggggcggagtcgggggtggagggagctggccacaacccactgctctgatgggtggtttgtccaaggatgctgaatgtaatgcctggtcaatgtggaagc

SEQ ID NO: 6173 - DNA, 201 bp, Homo sapiens
aagcggcctgacagtggagtggacagaagatgatctgcagcagggaaaaagaatcagtgtcccagaagatgtttatgacaagggttgcgtgaaagacgtaratgagggcttggaggcagcagaaagaattggttttccattgatgatcaaagcttctgaaggtggcggagggaagggaatccggaaggctgagagtgcgga

SEQ ID NO: 6174 - DNA, 201 bp, Homo sapiens
tgtgatatacctgagccagcacatcagcccagctgagcgggcgcaggtcgttcacctgctgtctaccatggacagcccggcctccacctgaccgtggcccrcccagccactcccgggaccacggcaaaaggaaccacccagacccaccacccgtacaccctcagcagaccctgaagacttgcttttaaacaaagaaaatcc

SEQ ID NO: 6175 - DNA, 201 bp, Homo sapiens
cgcaaacaaagtcgtgtgcatggcgtccttggaggtttacgtgcggaggggctacatcgcctatgagttaaacagcctgcagcaccggcagctcccggacrgcacctgcgtggtagaattccagttcatgctgccgtcctcccacccaaaccggatgaccgtgcccatcagcatcaccaaccctgacctgctgaggcacag

SEQ ID NO: 6176 - DNA, 201 bp, Homo sapiens
acccgtacaccctcagcagaccctgaagacttgcttttaaacaaagaaaatcctgggcacttctgcagggctgctggttccgagctgacacccgtcttaayaaaaggcccaggagtgcctcttccaaacaaaaacagcctcctctccatagctgggaagtttattttgttttgtctctgaagacagcagttttattgcatc

SEQ ID NO: 6177 - DNA, 201 bp, Homo sapiens
agcctggggccctgtgatcctctggtttcttccattggggcggagtcgggggtggagggagctggccacaacccactgctctgatgggtggtttgtccaargatgctgaatgtaatgcctggtcaatgtggaagcccatgaggttgcccagggaagcctccaaaagctgggatgcttgagggtatccaagttgaaaaagac

SEQ ID NO: 6178 - DNA, 201 bp, Homo sapiens
ctgaaccgttcacaggagaactccctgcccagcagacactgcccatcctcggagagaaactgcaccaggtcttccacagcgtcctggaaaacctcaccaaygtcatgagtggcttttgtctgccagagcccgtttttagcataaagctgaaggagtgggtgcagaagctcatgatgaccctccggcacccgtcactgccgc

SEQ ID NO: 6179 - DNA, 201 bp, Homo sapiens
ataactcaggggagacaccgcagagaaatggggagggccacactctgcccaagacacccagccaggccgagccagcctcccacaaaggccccaaagatgcyggtcggcggagaaactccctaccaccctcccaccagaagcccccaagaaaccccctttcttccagtgacgcagcaccctccccagagcttcaagccaacg

SEQ ID NO: 6180 - DNA, 201 bp, Homo sapiens
gggtgaagtacatcaagcgtccaggtgccgtgctggaagcaggctgcgtggtggccaggctggagctcgatgacccttctaaagtccacccggctgaaccrttcacaggagaactccctgcccagcagacactgcccatcctcggagagaaactgcaccaggtcttccacagcgtcctggaaaacctcaccaacgtcatga

SEQ ID NO: 6181 - DNA, 201 bp, Homo sapiens
acagagactttaccgtggcttctcccgctgagtttgtcacacgctttgggggggatcgggtcatcgagaaggtgcttattgccaacaacgggattgccgcygtgaagtgcatgcgctccatccgcaggtgggcctatgagatgttccgcaacgagcgggccatccggtttgttgtgatggtgacccccgaggaccttaagg

SEQ ID NO: 6182 - DNA, 201 bp, Homo sapiens
gtacccggaaggacgggatgtgatcgtcatcggcaatgacatcacctttcgcattggatcctttggccctggagaggaccttctgtacctgcgggcatccragatggcccgggcagagggcattcccaaaatttacgtggcagccaacagtggcgcccgtattggcatggcagaggagatcaaacacatgttccacgtggc

SEQ ID NO: 6183 - DNA, 201 bp, Homo sapiens
acggccttagacaatacaaacagcccatcctgatctatatcccgccctatgcggagctccggggaggctcctgggtggtcatagatgccaccatcaaccckctgtgcatagaaatgtatgcagacaaagagagcaggggtggtgttctggaaccagaggggacagtggagattaagttccgaaagaaagatctgataaagt

SEQ ID NO: 6184 - DNA, 201 bp, Homo sapiens
gactccccaagactacaccagaatcagctccctgaactccgtccactgtaaacacatcgaggaaggaggagagtccagatacatgatcacggatatcatcrggaaggatgatggcttgggcgtggagaatctgaggggctcaggcatgattgctggggagtcctctctggcttacgaagagatcgtcaccattagcttggt

SEQ ID NO: 6185 - DNA, 201 bp, Homo sapiens
gggagaacgttgcaatgcacccagcagctcctggctctgcaggcggcacagcctggggccctgtgatcctctggtttcttccattggggcggagtcggggrtggagggagctggccacaacccactgctctgatgggtggtttgtccaaggatgctgaatgtaatgcctggtcaatgtggaagcccatgaggttgcccagg

SEQ ID NO: 6186 - DNA, 201 bp, Homo sapiens
aattcctcccatccagagctccctacgacccccggtggatgcttgcaggaaggcctcacccaactctgaagggaacgtggcagagcggattctttgaccayggcagtttcaaggaaatcatggcaccctgggcgcagaccgtggtgacaggacgagcaaggcttggggggattcccgtgggagtgattgctgtggagacac

SEQ ID NO: 6187 - DNA, 201 bp, Homo sapiens
tggaggtggcagtccctgcagaccctgccaacctggattctgaggccaagataattcagcaggcaggacaggtgtggttcccagactcagcctacaaaacygcccaggccatcaaggacttcaaccgggagaagttgcccctgatgatctttgccaactggagggggttctccggtggcatgaaagacatgtatgaccagg

SEQ ID NO: 6188 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacagggttttaagccgagctccgggactgtccaggaactgaatttccggagcagcaagaacgtgtggggttacttca

SEQ ID NO: 6189 - DNA, 201 bp, Homo sapiens; identical to SEQ ID NO: 6158

SEQ ID NO: 6190 - DNA, 201 bp, Homo sapiens; identical to SEQ ID NO: 6159

SEQ ID NO: 6191 - DNA, 201 bp, Homo sapiens; identical to SEQ ID NO: 6160

SEQ ID NO: 6192 - DNA, 201 bp, Homo sapiens; identical to SEQ ID NO: 6161

SEQ ID NO: 6193 - DNA, 201 bp, Homo sapiens; identical to SEQ ID NO: 6162

SEQ ID NO: 6194 - DNA, 201 bp, Homo sapiens; identical to SEQ ID NO: 6164

SEQ ID NO: 6195 - DNA, 201 bp, Homo sapiens; identical to SEQ ID NO: 6165

SEQ ID NO: 6196 - DNA, 119 bp, Homo sapiens; identical to SEQ ID NO: 6167

SEQ ID NO: 6197 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaag

SEQ ID NO: 6198 - DNA, 201 bp, Homo sapiens; identical to SEQ ID NO: 6168

SEQ ID NO: 6199 - DNA, 201 bp, Homo sapiens; identical to SEQ ID NO: 6170

SEQ ID NO: 6200 - DNA, 201 bp, Homo sapiens; identical to SEQ ID NO: 6169

SEQ ID NO: 6201 - DNA, 201 bp, Homo sapiens; identical to SEQ ID NO: 6172

SEQ ID NO: 6202 - DNA, 201 bp, Homo sapiens; identical to SEQ ID NO: 6173

SEQ ID NO: 6203 - DNA, 201 bp, Homo sapiens; identical to SEQ ID NO: 6174

SEQ ID NO: 6204 - DNA, 201 bp, Homo sapiens; identical to SEQ ID NO: 6176

SEQ ID NO: 6205 - DNA, 201 bp, Homo sapiens; identical to SEQ ID NO: 6175

SEQ ID NO: 6206 - DNA, 201 bp, Homo sapiens; identical to SEQ ID NO: 6177

SEQ ID NO: 6207 - DNA, 201 bp, Homo sapiens; identical to SEQ ID NO: 6178

SEQ ID NO: 6208 - DNA, 201 bp, Homo sapiens; identical to SEQ ID NO: 6179

SEQ ID NO: 6209 - DNA, 201 bp, Homo sapiens; identical to SEQ ID NO: 6180

SEQ ID NO: 6210 - DNA, 201 bp, Homo sapiens; identical to SEQ ID NO: 6181

SEQ ID NO: 6211 - DNA, 201 bp, Homo sapiens; identical to SEQ ID NO: 6182

SEQ ID NO: 6212 - DNA, 201 bp, Homo sapiens; identical to SEQ ID NO: 6183

SEQ ID NO: 6213 - DNA, 201 bp, Homo sapiens; identical to SEQ ID NO: 6185

SEQ ID NO: 6214 - DNA, 201 bp, Homo sapiens; identical to SEQ ID NO: 6184

SEQ ID NO: 6215 - DNA, 201 bp, Homo sapiens; identical to SEQ ID NO: 6186

SEQ ID NO: 6216 - DNA, 201 bp, Homo sapiens; identical to SEQ ID NO: 6187

SEQ ID NO: 6217 - DNA, 201 bp, Homo sapiens; identical to SEQ ID NO: 6157

SEQ ID NO: 6218 - DNA, 201 bp, Homo sapiens; identical to SEQ ID NO: 6158

SEQ ID NO: 6219 - DNA, 201 bp, Homo sapiens; identical to SEQ ID NO: 6159

SEQ ID NO: 6220 - DNA, 201 bp, Homo sapiens; identical to SEQ ID NO: 6160

SEQ ID NO: 6221 - DNA, 201 bp, Homo sapiens; identical to SEQ ID NO: 6161

SEQ ID NO: 6222 - DNA, 201 bp, Homo sapiens
gctactggaggcctgcacgagtttgcggattcccaatttgggcactgcttctcctggggagagaaccgggaagaggccatttcgaactgtccatccgaggygactttaggactaccgtggaatacctcattaacctcctggagaccgagagcttccagaacaacgacatcgacaccgggtggttggactacctcattgctg

SEQ ID NO: 6223 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgaggcaaccgagctccgggactgtccaggaactgaatttccggagcagcaagaacgtgtggggttacttcagcg

SEQ ID NO: 6224 - DNA, 201 bp, Homo sapiens; identical to SEQ ID NO: 6164

SEQ ID NO: 6225 - DNA, 201 bp, Homo sapiens; identical to SEQ ID NO: 6165

SEQ ID NO: 6226 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaaa

SEQ ID NO: 6227 - DNA, 119 bp, Homo sapiens; identical to SEQ ID NO: 6167

SEQ ID NO: 6228 - DNA, 201 bp, Homo sapiens; identical to SEQ ID NO: 6168

SEQ ID NO: 6229 - DNA, 201 bp, Homo sapiens; identical to SEQ ID NO: 6169

SEQ ID NO: 6230 - DNA, 201 bp, Homo sapiens; identical to SEQ ID NO: 6170

SEQ ID NO: 6231 - DNA, 201 bp, Homo sapiens; identical to SEQ ID NO: 6171

SEQ ID NO: 6232 - DNA, 201 bp, Homo sapiens; identical to SEQ ID NO: 6172

SEQ ID NO: 6233 - DNA, 201 bp, Homo sapiens; identical to SEQ ID NO: 6173

SEQ ID NO: 6234 - DNA, 201 bp, Homo sapiens; identical to SEQ ID NO: 6174

SEQ ID NO: 6235 - DNA, 201 bp, Homo sapiens
catcttcgacgtcctgcctactttcttctatcacgcaaacaaagtcgtgtgcatggcgtccttggagttaaacagcctgcagcaccggcagctcccggacrgcacctgcgtggtagaattccagttcatgctgccgtcctcccacccaaaccggcacagcacagagctcttcatggacagcggcttctccccactgtgcca

SEQ ID NO: 6236 - DNA, 201 bp, Homo sapiens; identical to SEQ ID NO: 6176

SEQ ID NO: 6237 - DNA, 201 bp, Homo sapiens; identical to SEQ ID NO: 6177

SEQ ID NO: 6238 - DNA, 201 bp, Homo sapiens; identical to SEQ ID NO: 6178

SEQ ID NO: 6239 - DNA, 201 bp, Homo sapiens; identical to SEQ ID NO: 6179

SEQ ID NO: 6240 - DNA, 201 bp, Homo sapiens; identical to SEQ ID NO: 6180

SEQ ID NO: 6241 - DNA, 201 bp, Homo sapiens; identical to SEQ ID NO: 6181

SEQ ID NO: 6242 - DNA, 201 bp, Homo sapiens; identical to SEQ ID NO: 6182

SEQ ID NO: 6243 - DNA, 201 bp, Homo sapiens; identical to SEQ ID NO: 6183

SEQ ID NO: 6244 - DNA, 201 bp, Homo sapiens; identical to SEQ ID NO: 6184

SEQ ID NO: 6245 - DNA, 201 bp, Homo sapiens; identical to SEQ ID NO: 6185

SEQ ID NO: 6246 - DNA, 201 bp, Homo sapiens; identical to SEQ ID NO: 6186

SEQ ID NO: 6247 - DNA, 201 bp, Homo sapiens; identical to SEQ ID NO: 6187

SEQ ID NO: 6248 - DNA, 201 bp, Homo sapiens
agctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtttgatatttgacaaattgatctaaaatggctgggtttttatctgaa

SEQ ID NO: 6249 - DNA, 201 bp, Homo sapiens
cgttagaggagcaacaggagatgagagttccagattgttctgtccagtttccaaagggcagtaaagttttcgtgccggttttcagctattagcaactgtgmtacacttgcacctggtactgcacattttgtacaaagatatgctaagcagtagtcgtcaagttgcagatctttttgtgaaattcaacctgtgtcttatagg

SEQ ID NO: 6250 - DNA, 201 bp, Homo sapiens
atgttttgaggttgagtgacatgttcgaaacctgtccataaagtaattttgtgaaagaaggagcaagagaacattcctctgcagcacttcactaccaaatragcattagctacttttcagaattgaaggagaaaatgcattatgtggactgaaccgacttttctaaagctctgaacaaaagcttttctttccttttgcaac

SEQ ID NO: 6251 - DNA, 201 bp, Homo sapiens
cattcttacaagttatactcttatttggaaggccctaaagaaggcttatgaaattcagaagaacaaaccaagaaatgatgatatttttaagataattatgkcaattgtgcttttctttttcttttcctggattccccaccaaatattcacttttctggatgtattgattcaactaggcatcatacgtgactgtagaattgc

SEQ ID NO: 6252 - DNA, 201 bp, Homo sapiens
tattgttcacccaatgaagtcccgccttcgacgcacaatgcttgtagccaaagtcacctgcatcatcatttggctgctggcaggcttggccagtttgccarctataatccatcgaaatgtatttttcattgagaacaccaatattacagtttgtgctttccattatgagtcccaaaattcaaccctcccgatagggctggg

SEQ ID NO: 6253 - DNA, 201 bp, Homo sapiens
gatttaatatctgagaagtgtatatagtttgtggtaaaaagattatatatcataaagtatgccttcctgtttaaaaaaagtatatattctacacatatatrtatatgtatatctatatctctaaactgctgttaattgattaaaatctggcaaagttatatttactttaaaataaaataattttattgcaatgtatttatc

SEQ ID NO: 6254 - DNA, 201 bp, Homo sapiens
gaagatggtattaaaagaatccaagatgattgtcccaaagctggaaggcataattacatatttgtcatgattcctactttatacagtatcatctttgtggkgggaatatttggaaacagcttggtggtgatagtcatttacttttatatgaagctgaagactgtggccagtgtttttcttttgaatttagcactggctgac

SEQ ID NO: 6255 - DNA, 201 bp, Homo sapiens
ccccaaaagccaaatcccactcaaacctttcaacaaaaatgagcacgctttcctaccgcccctcagataatgtaagctcatccaccaagaagcctgcaccrtgttttgaggttgagtgacatgttcgaaacctgtccataaagtaattttgtgaaagaaggagcaagagaacattcctctgcagcacttcactaccaaatg

SEQ ID NO: 6256 - DNA, 201 bp, Homo sapiens
tttgaggttgagtgacatgttcgaaacctgtccataaagtaattttgtgaaagaaggagcaagagaacattcctctgcagcacttcactaccaaatgagcmttagctacttttcagaattgaaggagaaaatgcattatgtggactgaaccgacttttctaaagctctgaacaaaagcttttctttccttttgcaacaaga

SEQ ID NO: 6257 - DNA, 201 bp, Homo sapiens
tcaaacctttcaacaaaaatgagcacgctttcctaccgcccctcagataatgtaagctcatccaccaagaagcctgcaccatgttttgaggttgagtgacrtgttcgaaacctgtccataaagtaattttgtgaaagaaggagcaagagaacattcctctgcagcacttcactaccaaatgagcattagctacttttcaga

SEQ ID NO: 6258 - DNA, 130 bp, Homo sapiens
tatatgtatatctatatctctaaactgctgttaattgattaaaatctggcaaagttatatttactttaaaataaaataattttattgcaatgtatttatcktcattacttaaaatagatgctaatttatt

SEQ ID NO: 6259 - DNA, 201 bp, Homo sapiens
cctggattccccaccaaatattcacttttctggatgtattgattcaactaggcatcatacgtgactgtagaattgcagatattgtggacacggccatgccyatcaccatttgtatagcttattttaacaattgcctgaatcctcttttttatggctttctggggaaaaaatttaaaagatattttctccagcttctaaaat

SEQ ID NO: 6260 - DNA, 201 bp, Homo sapiens
gaagcctgcaccatgttttgaggttgagtgacatgttcgaaacctgtccataaagtaattttgtgaaagaaggagcaagagaacattcctctgcagcactkcactaccaaatgagcattagctacttttcagaattgaaggagaaaatgcattatgtggactgaaccgacttttctaaagctctgaacaaaagcttttctt

SEQ ID NO: 6261 - DNA, 201 bp, Homo sapiens
ctgtgctacacttgcacctggtactgcacattttgtacaaagatatgctaagcagtagtcgtcaagttgcagatctttttgtgaaattcaacctgtgtctyataggtttacactgccaaaacaatgcccgtaagatggcttatttgtataatggtgttactaaagtcacatataaaagttaaactacttgtaaaggtgctg

SEQ ID NO: 6262 - DNA, 201 bp, Homo sapiens
accaaatattcacttttctggatgtattgattcaactaggcatcatacgtgactgtagaattgcagatattgtggacacggccatgcctatcaccatttgkatagcttattttaacaattgcctgaatcctcttttttatggctttctggggaaaaaatttaaaagatattttctccagcttctaaaatatattcccccaa

SEQ ID NO: 6263 - DNA, 201 bp, Homo sapiens
agagttccagattgttctgtccagtttccaaagggcagtaaagttttcgtgccggttttcagctattagcaactgtgctacacttgcacctggtactgcayattttgtacaaagatatgctaagcagtagtcgtcaagttgcagatctttttgtgaaattcaacctgtgtcttataggtttacactgccaaaacaatgccc

SEQ ID NO: 6264 - DNA, 201 bp, Homo sapiens
tggctttctggggaaaaaatttaaaagatattttctccagcttctaaaatatattcccccaaaagccaaatcccactcaaacctttcaacaaaaatgagcmcgctttcctaccgcccctcagataatgtaagctcatccaccaagaagcctgcaccatgttttgaggttgagtgacatgttcgaaacctgtccataaagta

SEQ ID NO: 6265 - DNA, 201 bp, Homo sapiens
aactaggcatcatacgtgactgtagaattgcagatattgtggacacggccatgcctatcaccatttgtatagcttattttaacaattgcctgaatcctctkttttatggctttctggggaaaaaatttaaaagatattttctccagcttctaaaatatattcccccaaaagccaaatcccactcaaacctttcaacaaaaa

SEQ ID NO: 6266 - DNA, 201 bp, Homo sapiens
ttgagtgacatgttcgaaacctgtccataaagtaattttgtgaaagaaggagcaagagaacattcctctgcagcacttcactaccaaatgagcattagctrcttttcagaattgaaggagaaaatgcattatgtggactgaaccgacttttctaaagctctgaacaaaagcttttctttccttttgcaacaagacaaagca

SEQ ID NO: 6267 - DNA, 201 bp, Homo sapiens
atgacggctgctcgaagaacaatgtcagaaactcgatgaatgtgttgatttgagaaattttactgacagaaatgcaatctccctagcctgcttttgtcctrttattttttatttccacataaaggtatttagaatatattaaatcgttagaggagcaacaggagatgagagttccagattgttctgtccagtttccaaagg

SEQ ID NO: 6268 - DNA, 201 bp, Homo sapiens
aaagaaggagcaagagaacattcctctgcagcacttcactaccaaatgagcattagctacttttcagaattgaaggagaaaatgcattatgtggactgaaycgacttttctaaagctctgaacaaaagcttttctttccttttgcaacaagacaaagcaaagccacattttgcattagacagatgacggctgctcgaagaa

SEQ ID NO: 6269 - DNA, 201 bp, Homo sapiens
aaaggtatttagaatatattaaatcgttagaggagcaacaggagatgagagttccagattgttctgtccagtttccaaagggcagtaaagttttcgtgcckgttttcagctattagcaactgtgctacacttgcacctggtactgcacattttgtacaaagatatgctaagcagtagtcgtcaagttgcagatctttttgt

SEQ ID NO: 6270 - DNA, 201 bp, Homo sapiens
tggccagtttgccagctataatccatcgaaatgtatttttcattgagaacaccaatattacagtttgtgctttccattatgagtcccaaaattcaaccctyccgatagggctgggcctgaccaaaaatatactgggtttcctgtttccttttctgatcattcttacaagttatactcttatttggaaggccctaaagaagg

SEQ ID NO: 6271 - DNA, 201 bp, Homo sapiens
actgtagaattgcagatattgtggacacggccatgcctatcaccatttgtatagcttattttaacaattgcctgaatcctcttttttatggctttctgggraaaaaatttaaaagatattttctccagcttctaaaatatattcccccaaaagccaaatcccactcaaacctttcaacaaaaatgagcacgctttcctacc

SEQ ID NO: 6272 - DNA, 201 bp, Homo sapiens
tgcctatcaccatttgtatagcttattttaacaattgcctgaatcctcttttttatggctttctggggaaaaaatttaaaagatattttctccagcttctraaatatattcccccaaaagccaaatcccactcaaacctttcaacaaaaatgagcacgctttcctaccgcccctcagataatgtaagctcatccaccaaga

SEQ ID NO: 6273 - DNA, 201 bp, Homo sapiens
tgcccgtaagatggcttatttgtataatggtgttactaaagtcacatataaaagttaaactacttgtaaaggtgctgcactggtcccaagtagtagtgtcytcctagtatattagtttgatttaatatctgagaagtgtatatagtttgtggtaaaaagattatatatcataaagtatgccttcctgtttaaaaaaagtat

SEQ ID NO: 6274 - DNA, 201 bp, Homo sapiens
tagcttattttaacaattgcctgaatcctcttttttatggctttctggggaaaaaatttaaaagatattttctccagcttctaaaatatattcccccaaargccaaatcccactcaaacctttcaacaaaaatgagcacgctttcctaccgcccctcagataatgtaagctcatccaccaagaagcctgcaccatgttttg

SEQ ID NO: 6275 - DNA, 201 bp, Homo sapiens
acttgcacctggtactgcacattttgtacaaagatatgctaagcagtagtcgtcaagttgcagatctttttgtgaaattcaacctgtgtcttataggtttmcactgccaaaacaatgcccgtaagatggcttatttgtataatggtgttactaaagtcacatataaaagttaaactacttgtaaaggtgctgcactggtcc

SEQ ID NO: 6276 - DNA, 129 bp, Homo sapiens
agggcatgccattgcaagagaatgctcakccatgttcatctggggacctgctcctggtagagcaataggatctgtgtgcccagcaccactgcccacctagctgtcctggcctgtgcccaatgctgacct

SEQ ID NO: 6277 - DNA, 201 bp, Homo sapiens; identical to SEQ ID NO: 6249

SEQ ID NO: 6278 - DNA, 201 bp, Homo sapiens; identical to SEQ ID NO: 6250

SEQ ID NO: 6279 - DNA, 201 bp, Homo sapiens; identical to SEQ ID NO: 6251

SEQ ID NO: 6280 - DNA, 201 bp, Homo sapiens; identical to SEQ ID NO: 6252

SEQ ID NO: 6281 - DNA, 201 bp, Homo sapiens; identical to SEQ ID NO: 6253

SEQ ID NO: 6282 - DNA, 158 bp, Homo sapiens
agggcatgccattgcaagagaatgctcagccatgttcatctggggacctgctcctggyagagcaataggatctgtgtgcccagcaccactgcccacctagctgtcctggcctgtgcccaatgctgaccttcacctcagagtgtggctgtaccacattc

SEQ ID NO: 6283 - DNA, 201 bp, Homo sapiens; identical to SEQ ID NO: 6254

SEQ ID NO: 6284 - DNA, 201 bp, Homo sapiens; identical to SEQ ID NO: 6255

SEQ ID NO: 6285 - DNA, 201 bp, Homo sapiens; identical to SEQ ID NO: 6256

SEQ ID NO: 6286 - DNA, 201 bp, Homo sapiens; identical to SEQ ID NO: 6257

SEQ ID NO: 6287 - DNA, 130 bp, Homo sapiens; identical to SEQ ID NO: 6258

SEQ ID NO: 6288 - DNA, 201 bp, Homo sapiens; identical to SEQ ID NO: 6259

SEQ ID NO: 6289 - DNA, 201 bp, Homo sapiens; identical to SEQ ID NO: 6260

SEQ ID NO: 6290 - DNA, 201 bp, Homo sapiens; identical to SEQ ID NO: 6261

SEQ ID NO: 6291 - DNA, 201 bp, Homo sapiens; identical to SEQ ID NO: 6262

SEQ ID NO: 6292 - DNA, 201 bp, Homo sapiens; identical to SEQ ID NO: 6263

SEQ ID NO: 6293 - DNA, 201 bp, Homo sapiens; identical to SEQ ID NO: 6264

SEQ ID NO: 6294 - DNA, 201 bp, Homo sapiens; identical to SEQ ID NO: 6265

SEQ ID NO: 6295 - DNA, 201 bp, Homo sapiens; identical to SEQ ID NO: 6266

SEQ ID NO: 6296 - DNA, 201 bp, Homo sapiens; identical to SEQ ID NO: 6267

SEQ ID NO: 6297 - DNA, 201 bp, Homo sapiens; identical to SEQ ID NO: 6268

SEQ ID NO: 6298 - DNA, 201 bp, Homo sapiens; identical to SEQ ID NO: 6269

SEQ ID NO: 6299 - DNA, 201 bp, Homo sapiens; identical to SEQ ID NO: 6270

SEQ ID NO: 6300 - DNA, 201 bp, Homo sapiens; identical to SEQ ID NO: 6271

SEQ ID NO: 6301 - DNA, 201 bp, Homo sapiens; identical to SEQ ID NO: 6272

SEQ ID NO: 6302 - DNA, 201 bp, Homo sapiens; identical to SEQ ID NO: 6273

SEQ ID NO: 6303 - DNA, 201 bp, Homo sapiens; identical to SEQ ID NO: 6274

SEQ ID NO: 6304 - DNA, 201 bp, Homo sapiens; identical to SEQ ID NO: 6275

SEQ ID NO: 6305 - DNA, 200 bp, Homo sapiens
agggcatgccattgcaagagaatgctcagccatgttcatctggggacctgctcctggtagagcaataggatctgtgtgcccagcaccactgcccacctakctgtcctggcctgtgcccaatgctgaccttcacctcagagtgtggctgtaccacattcggtgtatttgatatagtgtttgcaacaaattcgacccaggtg

SEQ ID NO: 6306 - DNA, 201 bp, Homo sapiens
atctggggacctgctcctggtagagcaataggatctgtgtgcccagcaccactgcccacctagctgtcctggcctgtgcccaatgctgaccttcacctcakagtgtggctgtaccacattcggtgtatttgatatagtgtttgcaacaaattcgacccaggtgatcaaaatgattctcaactcttctactgaagatggtat

SEQ ID NO: 6307 - DNA, 201 bp, Homo sapiens
agctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcggatgaagaaaatgaatcacaagtcaactgacagtccaaaggctccacag

SEQ ID NO: 6308 - DNA, 201 bp, Homo sapiens; identical to SEQ ID NO: 6249

SEQ ID NO: 6309 - DNA, 201 bp, Homo sapiens; identical to SEQ ID NO: 6250

SEQ ID NO: 6310 - DNA, 201 bp, Homo sapiens; identical to SEQ ID NO: 6251

SEQ ID NO: 6311 - DNA, 201 bp, Homo sapiens; identical to SEQ ID NO: 6252

SEQ ID NO: 6312 - DNA, 201 bp, Homo sapiens; identical to SEQ ID NO: 6253

SEQ ID NO: 6313 - DNA, 201 bp, Homo sapiens; identical to SEQ ID NO: 6254

SEQ ID NO: 6314 - DNA, 201 bp, Homo sapiens; identical to SEQ ID NO: 6255

SEQ ID NO: 6315 - DNA, 201 bp, Homo sapiens; identical to SEQ ID NO: 6256

SEQ ID NO: 6316 - DNA, 201 bp, Homo sapiens; identical to SEQ ID NO: 6257

SEQ ID NO: 6317 - DNA, 130 bp, Homo sapiens; identical to SEQ ID NO: 6258

SEQ ID NO: 6318 - DNA, 201 bp, Homo sapiens; identical to SEQ ID NO: 6259

SEQ ID NO: 6319 - DNA, 201 bp, Homo sapiens; identical to SEQ ID NO: 6260

SEQ ID NO: 6320 - DNA, 201 bp, Homo sapiens; identical to SEQ ID NO: 6261

SEQ ID NO: 6321 - DNA, 201 bp, Homo sapiens; identical to SEQ ID NO: 6262

SEQ ID NO: 6322 - DNA, 201 bp, Homo sapiens; identical to SEQ ID NO: 6263

SEQ ID NO: 6323 - DNA, 201 bp, Homo sapiens; identical to SEQ ID NO: 6264

SEQ ID NO: 6324 - DNA, 201 bp, Homo sapiens; identical to SEQ ID NO: 6265

SEQ ID NO: 6325 - DNA, 201 bp, Homo sapiens; identical to SEQ ID NO: 6266

SEQ ID NO: 6326 - DNA, 201 bp, Homo sapiens; identical to SEQ ID NO: 6267

SEQ ID NO: 6327 - DNA, 201 bp, Homo sapiens; identical to SEQ ID NO: 6268

SEQ ID NO: 6328 - DNA, 201 bp, Homo sapiens; identical to SEQ ID NO: 6269

SEQ ID NO: 6329 - DNA, 201 bp, Homo sapiens; identical to SEQ ID NO: 6270

SEQ ID NO: 6330 - DNA, 201 bp, Homo sapiens
cgcagccggccctcggcgggacgtgacgcagcgcccggggcgcggatgaagaaaatgaatcacaagtcaactgacagtccaaaggctccacagctcagagraggtgtatttgatatagtgtttgcaacaaattcgacccaggtgatcaaaatgattctcaactcttctactgaagatggtattaaaagaatccaagatgat

SEQ ID NO: 6331 - DNA, 201 bp, Homo sapiens; identical to SEQ ID NO: 6271

SEQ ID NO: 6332 - DNA, 201 bp, Homo sapiens; identical to SEQ ID NO: 6272

SEQ ID NO: 6333 - DNA, 201 bp, Homo sapiens; identical to SEQ ID NO: 6273

SEQ ID NO: 6334 - DNA, 201 bp, Homo sapiens; identical to SEQ ID NO: 6274

SEQ ID NO: 6335 - DNA, 201 bp, Homo sapiens; identical to SEQ ID NO: 6275

SEQ ID NO: 6336 - DNA, 201 bp, Homo sapiens; identical to SEQ ID NO: 6248

SEQ ID NO: 6337 - DNA, 201 bp, Homo sapiens; identical to SEQ ID NO: 6249

SEQ ID NO: 6338 - DNA, 201 bp, Homo sapiens; identical to SEQ ID NO: 6250

SEQ ID NO: 6339 - DNA, 201 bp, Homo sapiens; identical to SEQ ID NO: 6251

SEQ ID NO: 6340 - DNA, 201 bp, Homo sapiens; identical to SEQ ID NO: 6252

SEQ ID NO: 6341 - DNA, 201 bp, Homo sapiens; identical to SEQ ID NO: 6253

SEQ ID NO: 6342 - DNA, 201 bp, Homo sapiens; identical to SEQ ID NO: 6254

SEQ ID NO: 6343 - DNA, 201 bp, Homo sapiens; identical to SEQ ID NO: 6255

SEQ ID NO: 6344 - DNA, 201 bp, Homo sapiens; identical to SEQ ID NO: 6256

SEQ ID NO: 6345 - DNA, 201 bp, Homo sapiens; identical to SEQ ID NO: 6257

SEQ ID NO: 6346 - DNA, 130 bp, Homo sapiens; identical to SEQ ID NO: 6258

SEQ ID NO: 6347 - DNA, 201 bp, Homo sapiens; identical to SEQ ID NO: 6259

SEQ ID NO: 6348 - DNA, 201 bp, Homo sapiens; identical to SEQ ID NO: 6260

SEQ ID NO: 6349 - DNA, 201 bp, Homo sapiens; identical to SEQ ID NO: 6261

SEQ ID NO: 6350 - DNA, 201 bp, Homo sapiens; identical to SEQ ID NO: 6262

SEQ ID NO: 6351 - DNA, 201 bp, Homo sapiens; identical to SEQ ID NO: 6263

SEQ ID NO: 6352 - DNA, 201 bp, Homo sapiens; identical to SEQ ID NO: 6264

SEQ ID NO: 6353 - DNA, 201 bp, Homo sapiens; identical to SEQ ID NO: 6265

SEQ ID NO: 6354 - DNA, 201 bp, Homo sapiens; identical to SEQ ID NO: 6266

SEQ ID NO: 6355 - DNA, 201 bp, Homo sapiens; identical to SEQ ID NO: 6267

SEQ ID NO: 6356 - DNA, 201 bp, Homo sapiens; identical to SEQ ID NO: 6268

SEQ ID NO: 6357 - DNA, 201 bp, Homo sapiens; identical to SEQ ID NO: 6269

SEQ ID NO: 6358 - DNA, 201 bp, Homo sapiens; identical to SEQ ID NO: 6270

SEQ ID NO: 6359 - DNA, 201 bp, Homo sapiens
ttatctgaataactcactgatgccatcccagaaagtcggcaccagatgaagaaaatgaatcacaagtcaactgacagtccaaaggctccacagctcagagraggtgtatttgatatagtgtttgcaacaaattcgacccaggtgatcaaaatgattctcaactcttctactgaagatggtattaaaagaatccaagatgat

SEQ ID NO: 6360 - DNA, 201 bp, Homo sapiens; identical to SEQ ID NO: 6271

SEQ ID NO: 6361 - DNA, 201 bp, Homo sapiens; identical to SEQ ID NO: 6272

SEQ ID NO: 6362 - DNA, 201 bp, Homo sapiens; identical to SEQ ID NO: 6273

SEQ ID NO: 6363 - DNA, 201 bp, Homo sapiens; identical to SEQ ID NO: 6274

SEQ ID NO: 6364 - DNA, 201 bp, Homo sapiens; identical to SEQ ID NO: 6275

SEQ ID NO: 6365 - DNA, 201 bp, Homo sapiens
agctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtgtatttgatatagtgtttgcaacaaattcgacccaggtgatcaaaa

SEQ ID NO: 6366 - DNA, 201 bp, Homo sapiens; identical to SEQ ID NO: 6249

SEQ ID NO: 6367 - DNA, 201 bp, Homo sapiens; identical to SEQ ID NO: 6250

SEQ ID NO: 6368 - DNA, 201 bp, Homo sapiens; identical to SEQ ID NO: 6251

SEQ ID NO: 6369 - DNA, 201 bp, Homo sapiens; identical to SEQ ID NO: 6252

SEQ ID NO: 6370 - DNA, 201 bp, Homo sapiens; identical to SEQ ID NO: 6253

SEQ ID NO: 6371 - DNA, 201 bp, Homo sapiens; identical to SEQ ID NO: 6254

SEQ ID NO: 6372 - DNA, 201 bp, Homo sapiens; identical to SEQ ID NO: 6255

SEQ ID NO: 6373 - DNA, 201 bp, Homo sapiens; identical to SEQ ID NO: 6256

SEQ ID NO: 6374 - DNA, 201 bp, Homo sapiens; identical to SEQ ID NO: 6257

SEQ ID NO: 6375 - DNA, 130 bp, Homo sapiens; identical to SEQ ID NO: 6258

SEQ ID NO: 6376 - DNA, 201 bp, Homo sapiens; identical to SEQ ID NO: 6259

SEQ ID NO: 6377 - DNA, 201 bp, Homo sapiens; identical to SEQ ID NO: 6260

SEQ ID NO: 6378 - DNA, 201 bp, Homo sapiens; identical to SEQ ID NO: 6261

SEQ ID NO: 6379 - DNA, 201 bp, Homo sapiens; identical to SEQ ID NO: 6262

SEQ ID NO: 6380 - DNA, 201 bp, Homo sapiens; identical to SEQ ID NO: 6263

SEQ ID NO: 6381 - DNA, 201 bp, Homo sapiens; identical to SEQ ID NO: 6264

SEQ ID NO: 6382 - DNA, 201 bp, Homo sapiens; identical to SEQ ID NO: 6265

SEQ ID NO: 6383 - DNA, 201 bp, Homo sapiens; identical to SEQ ID NO: 6266

SEQ ID NO: 6384 - DNA, 201 bp, Homo sapiens; identical to SEQ ID NO: 6267

SEQ ID NO: 6385 - DNA, 201 bp, Homo sapiens; identical to SEQ ID NO: 6268

SEQ ID NO: 6386 - DNA, 201 bp, Homo sapiens; identical to SEQ ID NO: 6269

SEQ ID NO: 6387 - DNA, 201 bp, Homo sapiens; identical to SEQ ID NO: 6270

SEQ ID NO: 6388 - DNA, 201 bp, Homo sapiens; identical to SEQ ID NO: 6271

SEQ ID NO: 6389 - DNA, 201 bp, Homo sapiens; identical to SEQ ID NO: 6272

SEQ ID NO: 6390 - DNA, 201 bp, Homo sapiens; identical to SEQ ID NO: 6273

SEQ ID NO: 6391 - DNA, 201 bp, Homo sapiens; identical to SEQ ID NO: 6274

SEQ ID NO: 6392 - DNA, 201 bp, Homo sapiens; identical to SEQ ID NO: 6275

SEQ ID NO: 6393 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaagacaatactgtgtatctttatgttgtgaatcatccccacatgaagtccactgt

SEQ ID NO: 6394 - DNA, 188 bp, Homo sapiens
agtcgccgctgggcaccccgagaccatggggaagctcgtggcgctggtcctgctgggggtcggcctgtccttagtcggggagatgttyctggcgtttagagaaagggtgaatgcctctcgagaagtggagccagtagaacctgaaaactgccaccttattgaggaacttgaaagtggctctgaagata

SEQ ID NO: 6395 - DNA, 201 bp, Homo sapiens
ccagtggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagacaatactgtgtatctttatgttgtgaatc

SEQ ID NO: 6396 - DNA, 201 bp, Homo sapiens
aaaacccaagggcacaagcactagaaatcagtggtggatttgacaaagaattatttaatccacatgggatcagtattttcatcgacaaagacaatactgtrtatctttatgttgtgaatcatccccacatgaagtccactgtggagatatttaaatttgaggaacaacaacgttctctggtatacctgaaaactataaaac

SEQ ID NO: 6397 - DNA, 201 bp, Homo sapiens
gaggaacaacaacgttctctggtatacctgaaaactataaaacatgaacttctcaaaagtgtgaatgacattgtggttcttggaccagaacagttctatgmcaccagagaccactattttaccaactccctcctgtcattttttgagatgatcttggatcttcgctggacttatgttcttttctacagcccaagggaggtt

SEQ ID NO: 6398 - DNA, 201 bp, Homo sapiens
gtagggcttttttttgagaatacactatcaaatcagtcttggaatacttgaaaacctcatttaccataaaaatccttctcactaaaatggataaatcagtyatgtcaattgtcagatattaaataacagtgtgtgaccccaaaagtacttaccctaaaacatgtgttgcctgaaagcacatgtgtgtatcgctgccttgcc

SEQ ID NO: 6399 - DNA, 201 bp, Homo sapiens
tgtgaccccaaaagtacttaccctaaaacatgtgttgcctgaaagcacatgtgtgtatcgctgccttgccatgtcttgttcagaagacacaggggagcagrgttagctcacgtgtctttagaactccagtactcacccagggactccagttcacaggccagaaaacatatgcattatgaagttcccctctactccatgcac

SEQ ID NO: 6400 - DNA, 201 bp, Homo sapiens
ataaacttctgcctaatttgaatgatattgttgctgtgggacctgagcacttttatggcacaaatgatcactattttcttgacccctacttacaatcctgrgagatgtatttgggtttagcgtggtcgtatgttgtctactatagtccaagtgaagttcgagtggtggcagaaggatttgattttgctaatggaatcaaca

SEQ ID NO: 6401 - DNA, 201 bp, Homo sapiens
ctactccatgcacatagtaagtctgactatggcagtcagacttacttactcccattttcccttcgatatatgactttttctcagtaaatattaacctgaaytattccaactccccttgtactcttgctttttcaattctcctgttgcaatgacacataggaaaatcttaaaattcttgggagtgttgtcacacctgaaaat

SEQ ID NO: 6402 - DNA, 201 bp, Homo sapiens
aggtaaacaaacaaataaatagaaaagatcaacaacccctttggctatctactgagacatgactaggaagaaaacatgactttatcattttgttatagaarctgatatataaaggttacacattttcatttatttgtttttctgatttgaaggtataaccttcatgatgaattacttcttcagggtgttaaggcagtgact

SEQ ID NO: 6403 - DNA, 201 bp, Homo sapiens
accctaaaacatgtgttgcctgaaagcacatgtgtgtatcgctgccttgccatgtcttgttcagaagacacaggggagcagggttagctcacgtgtctttrgaactccagtactcacccagggactccagttcacaggccagaaaacatatgcattatgaagttcccctctactccatgcacatagtaagtctgactatgg

SEQ ID NO: 6404 - DNA, 201 bp, Homo sapiens
tcatcgacaaagaacacgacttaatgctctccgagaggtacaacccgtagaacttcctaactgtaatttagttaaaggaatcgaaactggctctgaagacwtggagatactgcctaatggactggctttcattagctctggattaaagtatcctggaataaagagcttcaaccccaacagtcctggaaaaatacttctgat

SEQ ID NO: 6405 - DNA, 201 bp, Homo sapiens
ccagaaaacatatgcattatgaagttcccctctactccatgcacatagtaagtctgactatggcagtcagacttacttactcccattttcccttcgatatrtgactttttctcagtaaatattaacctgaactattccaactccccttgtactcttgctttttcaattctcctgttgcaatgacacataggaaaatcttaa

SEQ ID NO: 6406 - DNA, 201 bp, Homo sapiens
tccttctcactaaaatggataaatcagttatgtcaattgtcagatattaaataacagtgtgtgaccccaaaagtacttaccctaaaacatgtgttgcctgraagcacatgtgtgtatcgctgccttgccatgtcttgttcagaagacacaggggagcagggttagctcacgtgtctttagaactccagtactcacccaggg

SEQ ID NO: 6407 - DNA, 201 bp, Homo sapiens
catgtacctcctggtggtgaaccatccagatgccaagtccacagtggagttgtttaaatttcaagaagaagaaaaatcgcttttgcatctaaaaaccatcrgacataaacttctgcctaatttgaatgatattgttgctgtgggacctgagcacttttatggcacaaatgatcactattttcttgacccctacttacaatc

SEQ ID NO: 6408 - DNA, 201 bp, Homo sapiens
gagcttcaaccccaacagtcctggaaaaatacttctgatggacctgaatgaagaagatccaacagtgttggaattggggatcactggaagtaaatttgatrtatcttcatttaaccctcatgggattagcacattcacagatgaagataatgccatgtacctcctggtggtgaaccatccagatgccaagtccacagtgga

SEQ ID NO: 6409 - DNA, 201 bp, Homo sapiens
atactgcctaatggactggctttcattagctctggattaaagtatcctggaataaagagcttcaaccccaacagtcctggaaaaatacttctgatggaccygaatgaagaagatccaacagtgttggaattggggatcactggaagtaaatttgatgtatcttcatttaaccctcatgggattagcacattcacagatgaa

SEQ ID NO: 6410 - DNA, 201 bp, Homo sapiens
tgttgtcacacctgaaaattatgagtctctatgatcttggcacaaattgtacatttgagtgtctttgacttggttaaaggaagtttgttcacttcgatgaytggatacagaatgaatcccataattgacatgggcgaagctaaaagtgtccccaaagactacactgttgttgaggtggtggtagtgctggtgggtttttgt

SEQ ID NO: 6411 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaagaacacgacttaatgctctccgagaggtacaacccgtagaacttcctaactgt

SEQ ID NO: 6412 - DNA, 201 bp, Homo sapiens
atgagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagaacacgacttaatgctctccgagaggtaca

SEQ ID NO: 6413 - DNA, 201 bp, Homo sapiens
attaaagtatcctggaataaagagcttcaaccccaacagtcctggaaaaatacttctgatggacctgaatgaagaagatccaacagtgttggaattggggrtcactggaagtaaatttgatgtatcttcatttaaccctcatgggattagcacattcacagatgaagataatgccatgtacctcctggtggtgaaccatcc

SEQ ID NO: 6414 - DNA, 201 bp, Homo sapiens
atcagacataaacttctgcctaatttgaatgatattgttgctgtgggacctgagcacttttatggcacaaatgatcactattttcttgacccctacttacratcctgggagatgtatttgggtttagcgtggtcgtatgttgtctactatagtccaagtgaagttcgagtggtggcagaaggatttgattttgctaatgga

SEQ ID NO: 6415 - DNA, 201 bp, Homo sapiens; identical to SEQ ID NO: 6393

SEQ ID NO: 6416 - DNA, 188 bp, Homo sapiens; identical to SEQ ID NO: 6394

SEQ ID NO: 6417 - DNA, 201 bp, Homo sapiens
atgagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagacaatactgtgtatctttatgttgtgaatc

SEQ ID NO: 6418 - DNA, 201 bp, Homo sapiens; identical to SEQ ID NO: 6396

SEQ ID NO: 6419 - DNA, 201 bp, Homo sapiens; identical to SEQ ID NO: 6397

SEQ ID NO: 6420 - DNA, 201 bp, Homo sapiens
aggagcaaaatgggacttttggctgaaagtgctgagctcctgcggtgggggctgaccgcaagccacgccttctgtgcacctggtcggcccagctagctgcsgacccggcggggaggggcggggcgggccaatcggcgctgccccagcagggctgcggctgcaggcaggcagagcctcctagcccgtcggtgtctgcgccca

SEQ ID NO: 6421 - DNA, 201 bp, Homo sapiens; identical to SEQ ID NO: 6398

SEQ ID NO: 6422 - DNA, 201 bp, Homo sapiens; identical to SEQ ID NO: 6399

SEQ ID NO: 6423 - DNA, 201 bp, Homo sapiens; identical to SEQ ID NO: 6400

SEQ ID NO: 6424 - DNA, 201 bp, Homo sapiens; identical to SEQ ID NO: 6401

SEQ ID NO: 6425 - DNA, 201 bp, Homo sapiens; identical to SEQ ID NO: 6402

SEQ ID NO: 6426 - DNA, 201 bp, Homo sapiens; identical to SEQ ID NO: 6403

SEQ ID NO: 6427 - DNA, 201 bp, Homo sapiens
gtcttcttaccaaacacgacttaatgctctccgagaggtacaacccgtagaacttcctaactgtaatttagttaaaggaatcgaaactggctctgaagacwtggagatactgcctaatggactggctttcattagctctggattaaagtatcctggaataaagagcttcaaccccaacagtcctggaaaaatacttctgat

SEQ ID NO: 6428 - DNA, 201 bp, Homo sapiens; identical to SEQ ID NO: 6405

SEQ ID NO: 6429 - DNA, 201 bp, Homo sapiens; identical to SEQ ID NO: 6406

SEQ ID NO: 6430 - DNA, 201 bp, Homo sapiens; identical to SEQ ID NO: 6407

SEQ ID NO: 6431 - DNA, 201 bp, Homo sapiens
ttggctgaaagtgctgagctcctgcggtgggggctgaccgcaagccacgccttctgtgcacctggtcggcccagctagctgcggacccggcggggaggggyggggcgggccaatcggcgctgccccagcagggctgcggctgcaggcaggcagagcctcctagcccgtcggtgtctgcgcccatcgatccctttgtctatc

SEQ ID NO: 6432 - DNA, 201 bp, Homo sapiens; identical to SEQ ID NO: 6408

SEQ ID NO: 6433 - DNA, 201 bp, Homo sapiens; identical to SEQ ID NO: 6410

SEQ ID NO: 6434 - DNA, 201 bp, Homo sapiens; identical to SEQ ID NO: 6409

SEQ ID NO: 6435 - DNA, 201 bp, Homo sapiens; identical to SEQ ID NO: 6413

SEQ ID NO: 6436 - DNA, 201 bp, Homo sapiens; identical to SEQ ID NO: 6414

SEQ ID NO: 6437 - DNA, 201 bp, Homo sapiens
ttcatcccagaggggcatccgcctgtatgagttggaaggagcaaaatgggacttttggctgaaagtgctgagctcctgcggtgggggctgaccgcaagccrcgccttctgtgcacctggtcggcccagctagctgcggacccggcggggaggggcggggcgggccaatcggcgctgccccagcagggctgcggctgcaggc

SEQ ID NO: 6438 - DNA, 201 bp, Homo sapiens
aaaggagagcaacggggctgaggccgtgtcagcacgatggaccccaaacagaccaccctcctgtgtcttggggactttcccatgcctttcatatctgccamatcgagtcctgtgattcccttggatggatctgtgaaaatccagtgccaggccattcgtgaagcttacctgacccagctgatgatcataaaaaactccacg

SEQ ID NO: 6439 - DNA, 201 bp, Homo sapiens
gtggcaggactggtcctcgtggctctcttggccatactggttgaaaattggcacagccatacggcactgaacaaggaagcctcggcagatgtggctgaacygagctggagccaacagatgtgtcagccaggattgacctttgcacgaacaccaagtgtctgcaagtaaacacctggaggtgaaggcagagaggagccagga

SEQ ID NO: 6440 - DNA, 201 bp, Homo sapiens
tgagactgatcctgagttcgtcattgaccacatggacgcaaacaaggcagggcgctatcagtgccaatataggatagggcactacaggttccggtacagtracaccctggagctggtagtgacaggcttgtatggcaaacccttcctctctgcagatcggggtctggtgttgatgccaggagagaatatttccctcacgtg

SEQ ID NO: 6441 - DNA, 201 bp, Homo sapiens
tgaagttttggaatgagactgatcctgagttcgtcattgaccacatggacgcaaacaaggcagggcgctatcagtgccaatataggatagggcactacagrttccggtacagtgacaccctggagctggtagtgacaggcttgtatggcaaacccttcctctctgcagatcggggtctggtgttgatgccaggagagaata

SEQ ID NO: 6442 - DNA, 156 bp, Homo sapiens
tccacccaagagcaacctggaactaagttattcggcaacgaactgttccactttgytgtgaggcaatagatgtggaaattccctgacgaggggctctgtcctcatacttcctgcggagcttattgtcgtaagaatatctgtcatcctgctaatgtg

SEQ ID NO: 6443 - DNA, 201 bp, Homo sapiens
actggtcctcgtggctctcttggccatactggttgaaaattggcacagccatacggcactgaacaaggaagcctcggcagatgtggctgaaccgagctggrgccaacagatgtgtcagccaggattgacctttgcacgaacaccaagtgtctgcaagtaaacacctggaggtgaaggcagagaggagccaggactgtggag

SEQ ID NO: 6444 - DNA, 201 bp, Homo sapiens
gcaaacccttcctctctgcagatcggggtctggtgttgatgccaggagagaatatttccctcacgtgcagctcagcacacatcccatttgatagattttcwctggccaaggagggagaactttctctgccacagcaccaaagtggggaacacccggccaacttctctttgggtcctgtggacctcaatgtctcagggatct

SEQ ID NO: 6445 - DNA, 201 bp, Homo sapiens
agcgagcatttttggtgttgaagtttgggctgcaatccggtaaatgatgcttcagcacaacggccagtaggggactttcccatgcctttcatatctgccamatcgagtcctgtgattcccttggatggatctgtgaaaatccagtgccaggccattcgtgaagcttacctgacccagctgatgatcataaaaaactccacg

SEQ ID NO: 6446 - DNA, 165 bp, Homo sapiens
gtggcaggactggtcctcgtggctctcttggccatactggttgaaaattggcacagccatacggcactgaacaaggaagcctcggcagatgtggctgaacygagctggagccaacagatgtgtcagccaggattgacctttgcacgaacaccaagtgtctgcaag

SEQ ID NO: 6447 - DNA, 201 bp, Homo sapiens
tgagactgatcctgagttcgtcattgaccacatggacgcaaacaaggcagggcgctatcagtgccaatataggatagggcactacaggttccggtacagtracaccctggagctggtagtgacagactccatccaccaagattacacgacgcagaacttgatccgcatggccgtggcaggactggtcctcgtggctctctt

SEQ ID NO: 6448 - DNA, 201 bp, Homo sapiens
tgaagttttggaatgagactgatcctgagttcgtcattgaccacatggacgcaaacaaggcagggcgctatcagtgccaatataggatagggcactacagrttccggtacagtgacaccctggagctggtagtgacagactccatccaccaagattacacgacgcagaacttgatccgcatggccgtggcaggactggtcc

SEQ ID NO: 6449 - DNA, 157 bp, Homo sapiens
actggtcctcgtggctctcttggccatactggttgaaaattggcacagccatacggcactgaacaaggaagcctcggcagatgtggctgaaccgagctggrgccaacagatgtgtcagccaggattgacctttgcacgaacaccaagtgtctgcaag

SEQ ID NO: 6450 - DNA, 201 bp, Homo sapiens; identical to SEQ ID NO: 6445

SEQ ID NO: 6451 - DNA, 165 bp, Homo sapiens; identical to SEQ ID NO: 6446

SEQ ID NO: 6452 - DNA, 201 bp, Homo sapiens; identical to SEQ ID NO: 6447

SEQ ID NO: 6453 - DNA, 201 bp, Homo sapiens; identical to SEQ ID NO: 6448

SEQ ID NO: 6454 - DNA, 156 bp, Homo sapiens; identical to SEQ ID NO: 6442

SEQ ID NO: 6455 - DNA, 157 bp, Homo sapiens; identical to SEQ ID NO: 6449

SEQ ID NO: 6456 - DNA, 201 bp, Homo sapiens
atggaccccaaacagaccaccctcctgtgtcttgtgctctgtctgggccagaggattcaggcacaggaaggggactttcccatgcctttcatatctgccamatcgagtcctgtgattcccttggatggatctgtgaaaatccagtgccaggccattcgtgaagcttacctgacccagctgatgatcataaaaaactccacg

SEQ ID NO: 6457 - DNA, 201 bp, Homo sapiens; identical to SEQ ID NO: 6439

SEQ ID NO: 6458 - DNA, 201 bp, Homo sapiens; identical to SEQ ID NO: 6440

SEQ ID NO: 6459 - DNA, 201 bp, Homo sapiens; identical to SEQ ID NO: 6441

SEQ ID NO: 6460 - DNA, 156 bp, Homo sapiens; identical to SEQ ID NO: 6442

SEQ ID NO: 6461 - DNA, 201 bp, Homo sapiens; identical to SEQ ID NO: 6443

SEQ ID NO: 6462 - DNA, 201 bp, Homo sapiens; identical to SEQ ID NO: 6444

SEQ ID NO: 6463 - DNA, 201 bp, Homo sapiens; identical to SEQ ID NO: 6445

SEQ ID NO: 6464 - DNA, 201 bp, Homo sapiens; identical to SEQ ID NO: 6439

SEQ ID NO: 6465 - DNA, 201 bp, Homo sapiens; identical to SEQ ID NO: 6440

SEQ ID NO: 6466 - DNA, 201 bp, Homo sapiens; identical to SEQ ID NO: 6441

SEQ ID NO: 6467 - DNA, 156 bp, Homo sapiens; identical to SEQ ID NO: 6442

SEQ ID NO: 6468 - DNA, 201 bp, Homo sapiens; identical to SEQ ID NO: 6443

SEQ ID NO: 6469 - DNA, 201 bp, Homo sapiens; identical to SEQ ID NO: 6444

SEQ ID NO: 6470 - DNA, 201 bp, Homo sapiens; identical to SEQ ID NO: 6438

SEQ ID NO: 6471 - DNA, 201 bp, Homo sapiens
gcccaggctggagtgcagtggcacgatctcggctcactgcaacctctgcctcctgggttcaagtgattctcctgcctcggcctcccaagtagctgggattrcaggctcccaccatcacgcccagctacttttacagtatttttagtagagacggggtttcatcacattggccaagctggtctcaaacttctgacctcgtga

SEQ ID NO: 6472 - DNA, 177 bp, Homo sapiens
attgctatttacttcattgtccagtagcttatgtatgaaaatataattataaaatgtaagggtcctacttccagtgaaactgaagggacttaggcccactkttatcctttactgagagcttatctctacttgataaaatttctactgtattcttggcttaactcaggtcctgtgatt

SEQ ID NO: 6473 - DNA, 201 bp, Homo sapiens
aaaccaatcaaatggtgttttcttatgcaggactgatcgatttgcacccacctttctgcacataagttatggttttccatcttatctgtcttctgattttktatatcctgtttaatttcttccttcattgttcttctctttttttatttattttatttatttttatttttatttttatttgagacagagtctcactctgtt

SEQ ID NO: 6474 - DNA, 201 bp, Homo sapiens
gcatgttcaaaccaatcaaatggtgttttcttatgcaggactgatcgatttgcacccacctttctgcacataagttatggttttccatcttatctgtcttytgattttttatatcctgtttaatttcttccttcattgttcttctctttttttatttattttatttatttttatttttatttttatttgagacagagtctc

SEQ ID NO: 6475 - DNA, 156 bp, Homo sapiens; identical to SEQ ID NO: 6442

SEQ ID NO: 6476 - DNA, 201 bp, Homo sapiens; identical to SEQ ID NO: 6439

SEQ ID NO: 6477 - DNA, 201 bp, Homo sapiens; identical to SEQ ID NO: 6447

SEQ ID NO: 6478 - DNA, 201 bp, Homo sapiens; identical to SEQ ID NO: 6473

SEQ ID NO: 6479 - DNA, 201 bp, Homo sapiens; identical to SEQ ID NO: 6448

SEQ ID NO: 6480 - DNA, 156 bp, Homo sapiens; identical to SEQ ID NO: 6442

SEQ ID NO: 6481 - DNA, 201 bp, Homo sapiens; identical to SEQ ID NO: 6474

SEQ ID NO: 6482 - DNA, 201 bp, Homo sapiens; identical to SEQ ID NO: 6443

SEQ ID NO: 6483 - DNA, 201 bp, Homo sapiens; identical to SEQ ID NO: 6456

SEQ ID NO: 6484 - DNA, 201 bp, Homo sapiens
cttctctttgggtcctgtggacctcaatgtctcagggatctacaggtgctacggttggtacaacaggagcccctacctgtggtccttccccagtaatgccytggagcttgtggtcacaggtaggtaccgcccagtccagccctgtgtctgggttggctgtccagggccttgccaccgggcaggaatatgaagacgtgcact

SEQ ID NO: 6485 - DNA, 201 bp, Homo sapiens; identical to SEQ ID NO: 6440

SEQ ID NO: 6486 - DNA, 201 bp, Homo sapiens; identical to SEQ ID NO: 6441

SEQ ID NO: 6487 - DNA, 156 bp, Homo sapiens; identical to SEQ ID NO: 6442

SEQ ID NO: 6488 - DNA, 201 bp, Homo sapiens; identical to SEQ ID NO: 6444

SEQ ID NO: 6489 - DNA, 201 bp, Homo sapiens; identical to SEQ ID NO: 6438

SEQ ID NO: 6490 - DNA, 201 bp, Homo sapiens
taatgccttggagcttgtggtcacaggtaggtaccgcccagtccagccctgtgtctgggttggctgtccagggccttgccaccgggcaggaatatgaagaygtgcactgagagtgaagtgaagagaggcaaaggctctcactccaggacagtggagagagaaaggcttccccaccacactttccgctttcacttcctcgct

SEQ ID NO: 6491 - DNA, 201 bp, Homo sapiens
acaggtgctacggttggtacaacaggagcccctacctgtggtccttccccagtaatgccttggagcttgtggtcacaggtaggtaccgcccagtccagccytgtgtctgggttggctgtccagggccttgccaccgggcaggaatatgaagacgtgcactgagagtgaagtgaagagaggcaaaggctctcactccaggac

SEQ ID NO: 6492 - DNA, 201 bp, Homo sapiens; identical to SEQ ID NO: 6439

SEQ ID NO: 6493 - DNA, 201 bp, Homo sapiens; identical to SEQ ID NO: 6440

SEQ ID NO: 6494 - DNA, 201 bp, Homo sapiens; identical to SEQ ID NO: 6473

SEQ ID NO: 6495 - DNA, 201 bp, Homo sapiens; identical to SEQ ID NO: 6441

SEQ ID NO: 6496 - DNA, 156 bp, Homo sapiens; identical to SEQ ID NO: 6442

SEQ ID NO: 6497 - DNA, 201 bp, Homo sapiens; identical to SEQ ID NO: 6474

SEQ ID NO: 6498 - DNA, 201 bp, Homo sapiens; identical to SEQ ID NO: 6443

SEQ ID NO: 6499 - DNA, 201 bp, Homo sapiens; identical to SEQ ID NO: 6444

SEQ ID NO: 6500 - DNA, 201 bp, Homo sapiens; identical to SEQ ID NO: 6438

SEQ ID NO: 6501 - DNA, 201 bp, Homo sapiens
cttctctttgggtcctgtggacctcaatgtctcagggatctacaggtgctacggttggtacaacaggagcccctacctgtggtccttccccagtaatgccytggagcttgtggtcacagactccatccaccaagattacacgacgcagaacttgatccgcatggccgtggcaggactggtcctcgtggctctcttggccat

SEQ ID NO: 6502 - DNA, 201 bp, Homo sapiens; identical to SEQ ID NO: 6439

SEQ ID NO: 6503 - DNA, 201 bp, Homo sapiens; identical to SEQ ID NO: 6440

SEQ ID NO: 6504 - DNA, 201 bp, Homo sapiens; identical to SEQ ID NO: 6473

SEQ ID NO: 6505 - DNA, 201 bp, Homo sapiens; identical to SEQ ID NO: 6441

SEQ ID NO: 6506 - DNA, 156 bp, Homo sapiens; identical to SEQ ID NO: 6442

SEQ ID NO: 6507 - DNA, 201 bp, Homo sapiens; identical to SEQ ID NO: 6474

SEQ ID NO: 6508 - DNA, 201 bp, Homo sapiens; identical to SEQ ID NO: 6443

SEQ ID NO: 6509 - DNA, 201 bp, Homo sapiens; identical to SEQ ID NO: 6444

SEQ ID NO: 6510 - DNA, 201 bp, Homo sapiens; identical to SEQ ID NO: 6456

SEQ ID NO: 6511 - DNA, 201 bp, Homo sapiens; identical to SEQ ID NO: 6439

SEQ ID NO: 6512 - DNA, 201 bp, Homo sapiens; identical to SEQ ID NO: 6447

SEQ ID NO: 6513 - DNA, 201 bp, Homo sapiens; identical to SEQ ID NO: 6473

SEQ ID NO: 6514 - DNA, 201 bp, Homo sapiens; identical to SEQ ID NO: 6448

SEQ ID NO: 6515 - DNA, 156 bp, Homo sapiens; identical to SEQ ID NO: 6442

SEQ ID NO: 6516 - DNA, 201 bp, Homo sapiens; identical to SEQ ID NO: 6474

SEQ ID NO: 6517 - DNA, 201 bp, Homo sapiens; identical to SEQ ID NO: 6443

SEQ ID NO: 6518 - DNA, 201 bp, Homo sapiens; identical to SEQ ID NO: 6438

SEQ ID NO: 6519 - DNA, 201 bp, Homo sapiens; identical to SEQ ID NO: 6501

SEQ ID NO: 6520 - DNA, 201 bp, Homo sapiens; identical to SEQ ID NO: 6439

SEQ ID NO: 6521 - DNA, 201 bp, Homo sapiens; identical to SEQ ID NO: 6473

SEQ ID NO: 6522 - DNA, 156 bp, Homo sapiens; identical to SEQ ID NO: 6442

SEQ ID NO: 6523 - DNA, 201 bp, Homo sapiens; identical to SEQ ID NO: 6474

SEQ ID NO: 6524 - DNA, 201 bp, Homo sapiens; identical to SEQ ID NO: 6443

SEQ ID NO: 6525 - DNA, 201 bp, Homo sapiens; identical to SEQ ID NO: 6444

SEQ ID NO: 6526 - DNA, 201 bp, Homo sapiens; identical to SEQ ID NO: 6439

SEQ ID NO: 6527 - DNA, 201 bp, Homo sapiens; identical to SEQ ID NO: 6440

SEQ ID NO: 6528 - DNA, 201 bp, Homo sapiens; identical to SEQ ID NO: 6473

SEQ ID NO: 6529 - DNA, 201 bp, Homo sapiens; identical to SEQ ID NO: 6441

SEQ ID NO: 6530 - DNA, 156 bp, Homo sapiens; identical to SEQ ID NO: 6442

SEQ ID NO: 6531 - DNA, 201 bp, Homo sapiens; identical to SEQ ID NO: 6474

SEQ ID NO: 6532 - DNA, 201 bp, Homo sapiens; identical to SEQ ID NO: 6443

SEQ ID NO: 6533 - DNA, 201 bp, Homo sapiens; identical to SEQ ID NO: 6444

SEQ ID NO: 6534 - DNA, 201 bp, Homo sapiens; identical to SEQ ID NO: 6456

SEQ ID NO: 6535 - DNA, 201 bp, Homo sapiens; identical to SEQ ID NO: 6484

SEQ ID NO: 6536 - DNA, 201 bp, Homo sapiens; identical to SEQ ID NO: 6440

SEQ ID NO: 6537 - DNA, 201 bp, Homo sapiens; identical to SEQ ID NO: 6441

SEQ ID NO: 6538 - DNA, 156 bp, Homo sapiens; identical to SEQ ID NO: 6442

SEQ ID NO: 6539 - DNA, 201 bp, Homo sapiens; identical to SEQ ID NO: 6444

SEQ ID NO: 6540 - DNA, 201 bp, Homo sapiens; identical to SEQ ID NO: 6456

SEQ ID NO: 6541 - DNA, 201 bp, Homo sapiens; identical to SEQ ID NO: 6490

SEQ ID NO: 6542 - DNA, 201 bp, Homo sapiens; identical to SEQ ID NO: 6491

SEQ ID NO: 6543 - DNA, 201 bp, Homo sapiens; identical to SEQ ID NO: 6501

SEQ ID NO: 6544 - DNA, 201 bp, Homo sapiens; identical to SEQ ID NO: 6439

SEQ ID NO: 6545 - DNA, 201 bp, Homo sapiens; identical to SEQ ID NO: 6440

SEQ ID NO: 6546 - DNA, 201 bp, Homo sapiens; identical to SEQ ID NO: 6473

SEQ ID NO: 6547 - DNA, 201 bp, Homo sapiens; identical to SEQ ID NO: 6441

SEQ ID NO: 6548 - DNA, 156 bp, Homo sapiens; identical to SEQ ID NO: 6442

SEQ ID NO: 6549 - DNA, 201 bp, Homo sapiens; identical to SEQ ID NO: 6474

SEQ ID NO: 6550 - DNA, 201 bp, Homo sapiens; identical to SEQ ID NO: 6443

SEQ ID NO: 6551 - DNA, 201 bp, Homo sapiens; identical to SEQ ID NO: 6444

SEQ ID NO: 6552 - DNA, 201 bp, Homo sapiens; identical to SEQ ID NO: 6438

SEQ ID NO: 6553 - DNA, 201 bp, Homo sapiens; identical to SEQ ID NO: 6439

SEQ ID NO: 6554 - DNA, 201 bp, Homo sapiens; identical to SEQ ID NO: 6440

SEQ ID NO: 6555 - DNA, 201 bp, Homo sapiens; identical to SEQ ID NO: 6473

SEQ ID NO: 6556 - DNA, 201 bp, Homo sapiens; identical to SEQ ID NO: 6441

SEQ ID NO: 6557 - DNA, 156 bp, Homo sapiens; identical to SEQ ID NO: 6442

SEQ ID NO: 6558 - DNA, 201 bp, Homo sapiens; identical to SEQ ID NO: 6474

SEQ ID NO: 6559 - DNA, 201 bp, Homo sapiens; identical to SEQ ID NO: 6443

SEQ ID NO: 6560 - DNA, 201 bp, Homo sapiens; identical to SEQ ID NO: 6444

SEQ ID NO: 6561 - DNA, 201 bp, Homo sapiens; identical to SEQ ID NO: 6438

SEQ ID NO: 6562 - DNA, 201 bp, Homo sapiens; identical to SEQ ID NO: 6484

SEQ ID NO: 6563 - DNA, 201 bp, Homo sapiens; identical to SEQ ID NO: 6440

SEQ ID NO: 6564 - DNA, 201 bp, Homo sapiens; identical to SEQ ID NO: 6441

SEQ ID NO: 6565 - DNA, 156 bp, Homo sapiens; identical to SEQ ID NO: 6442

SEQ ID NO: 6566 - DNA, 201 bp, Homo sapiens; identical to SEQ ID NO: 6444

SEQ ID NO: 6567 - DNA, 201 bp, Homo sapiens; identical to SEQ ID NO: 6456

SEQ ID NO: 6568 - DNA, 201 bp, Homo sapiens; identical to SEQ ID NO: 6490

SEQ ID NO: 6569 - DNA, 201 bp, Homo sapiens; identical to SEQ ID NO: 6491

SEQ ID NO: 6570 - DNA, 201 bp, Homo sapiens
aatattcctgtggtgtctggcaaagaatgtgaggaaattatcaggaaaggaggtgaaacatctgaaatgtatctcattcaacctgacagttctgtcaaacygtatagagtatactgtgacatgaatacagaaaatggaggatggacagtgattcagaaccgtcaagacggtagtgttgactttggcaggaaatgggatcca

SEQ ID NO: 6571 - DNA, 168 bp, Homo sapiens
tgaagtcattcctagcagaggactcagatatatataggattgaagatctctcagttaagtctacatgraaaggatggtttcttggagcttccacaaacttaaaaccatgaaacatctattattgctactattgtgtgtttttctagttaagtcccaaggtgtcaacga

SEQ ID NO: 6572 - DNA, 201 bp, Homo sapiens
gaggtgaaacatctgaaatgtatctcattcaacctgacagttctgtcaaaccgtatagagtatactgtgacatgaatacagaaaatggaggatggacagtkattcagaaccgtcaagacggtagtgttgactttggcaggaaatgggatccatataaacagggatttggaaatgttgcaaccaacacagatgggaagaatt

SEQ ID NO: 6573 - DNA, 201 bp, Homo sapiens
aagaggcagaagcaagtaaaagataatgaaaatgtagtcaatgagtactcctcagaactggaaaagcaccaattatatatagatgagactgtgaatagcartatcccaactaaccttcgtgtgcttcgttcaatcctggaaaacctgagaagcaaaatacaaaagttagaatctgatgtctcagctcaaatggaatattgt

SEQ ID NO: 6574 - DNA, 201 bp, Homo sapiens
cagaacttttgatagaaatggaggactggaaaggagacaaagtaaaggctcactatggaggattcactgtacagaatgaagccaacaaataccagatctcrgtgaacaaatacagaggaacagccggtaatgccctcatggatggagcatctcagctgatgggagaaaacaggaccatgaccattcacaacggcatgttct

SEQ ID NO: 6575 - DNA, 201 bp, Homo sapiens
aaaagataatgaaaatgtagtcaatgagtactcctcagaactggaaaagcaccaattatatatagatgagactgtgaatagcaatatcccaactaaccttygtgtgcttcgttcaatcctggaaaacctgagaagcaaaatacaaaagttagaatctgatgtctcagctcaaatggaatattgtcgcaccccatgcactgt

SEQ ID NO: 6576 - DNA, 201 bp, Homo sapiens
ccatgaaacatctattattgctactattgtgtgtttttctagttaagtcccaaggtgtcaacgacaatgaggagggtttcttcagtgcccgtggtcatcgrccccttgacaagaagagagaagaggctttgctacaacaggaaaggccaatcagaaatagtgttgatgagttaaataacaatgtggaagctgtttcccaga

SEQ ID NO: 6577 - DNA, 201 bp, Homo sapiens
tctgaaatgtatctcattcaacctgacagttctgtcaaaccgtatagagtatactgtgacatgaatacagaaaatggaggatggacagtgattcagaaccrtcaagacggtagtgttgactttggcaggaaatgggatccatataaacagggatttggaaatgttgcaaccaacacagatgggaagaattactgtggccta

SEQ ID NO: 6578 - DNA, 201 bp, Homo sapiens
gaagaattactgtggcctaccaggtgaatattggcttggaaatgataaaattagccagcttaccaggatgggacccacagaacttttgatagaaatggagkactggaaaggagacaaagtaaaggctcactatggaggattcactgtacagaatgaagccaacaaataccagatctcagtgaacaaatacagaggaacagc

SEQ ID NO: 6579 - DNA, 201 bp, Homo sapiens
caaacttaaaaccatgaaacatctattattgctactattgtgtgtttttctagttaagtcccaaggtgtcaacgacaatgaggagggtttcttcagtgccygtggtcatcgaccccttgacaagaagagagaagaggctttgctacaacaggaaaggccaatcagaaatagtgttgatgagttaaataacaatgtggaagc

SEQ ID NO: 6580 - DNA, 201 bp, Homo sapiens
gcttaccaggatgggacccacagaacttttgatagaaatggaggactggaaaggagacaaagtaaaggctcactatggaggattcactgtacagaatgaarccaacaaataccagatctcagtgaacaaatacagaggaacagccggtaatgccctcatggatggagcatctcagctgatgggagaaaacaggaccatgac

SEQ ID NO: 6581 - DNA, 201 bp, Homo sapiens
agatactactggggtggacagtacacctgggacatggcaaagcatggcacagatgatggtgtagtatggatgaattggaaggggtcatggtactcaatgargaagatgagtatgaagatcaggcccttcttcccacagcaatagtccccaatacgtagatttttgctcttctgtatgtgacaacatttttgtacattatgt

SEQ ID NO: 6582 - DNA, 201 bp, Homo sapiens
acttaaaaccatgaaacatctattattgctactattgtgtgtttttctagttaagtcccaaggtgtcaacgacaatgaggagggtttcttcagtgcccgtkgtcatcgaccccttgacaagaagagagaagaggctttgctacaacaggaaaggccaatcagaaatagtgttgatgagttaaataacaatgtggaagctgt

SEQ ID NO: 6583 - DNA, 201 bp, Homo sapiens
gacaaagtaaaggctcactatggaggattcactgtacagaatgaagccaacaaataccagatctcagtgaacaaatacagaggaacagccggtaatgccckcatggatggagcatctcagctgatgggagaaaacaggaccatgaccattcacaacggcatgttcttcagcacgtatgacagagacaatgacggctggtta

SEQ ID NO: 6584 - DNA, 201 bp, Homo sapiens
tagaaatggaggactggaaaggagacaaagtaaaggctcactatggaggattcactgtacagaatgaagccaacaaataccagatctcagtgaacaaatayagaggaacagccggtaatgccctcatggatggagcatctcagctgatgggagaaaacaggaccatgaccattcacaacggcatgttcttcagcacgtatg

SEQ ID NO: 6585 - DNA, 201 bp, Homo sapiens
atgaccattcacaacggcatgttcttcagcacgtatgacagagacaatgacggctggttaacatcagatcccagaaaacagtgttctaaagaagacggtgrtggatggtggtataatagatgtcatgcagccaatccaaacggcagatactactggggtggacagtacacctgggacatggcaaagcatggcacagatgat

SEQ ID NO: 6586 - DNA, 201 bp, Homo sapiens
tcaatgagtactcctcagaactggaaaagcaccaattatatatagatgagactgtgaatagcaatatcccaactaaccttcgtgtgcttcgttcaatcctrgaaaacctgagaagcaaaatacaaaagttagaatctgatgtctcagctcaaatggaatattgtcgcaccccatgcactgtcagttgcaatattcctgtgg

SEQ ID NO: 6587 - DNA, 201 bp, Homo sapiens
tgtcatgcagccaatccaaacggcagatactactggggtggacagtacacctgggacatggcaaagcatggcacagatgatggtgtagtatggatgaattrgaaggggtcatggtactcaatgaggaagatgagtatgaagatcaggcccttcttcccacagcaatagtccccaatacgtagatttttgctcttctgtatg

SEQ ID NO: 6588 - DNA, 201 bp, Homo sapiens
gcagaagcaagtaaaagataatgaaaatgtagtcaatgagtactcctcagaactggaaaagcaccaattatatatagatgagactgtgaatagcaatatcscaactaaccttcgtgtgcttcgttcaatcctggaaaacctgagaagcaaaatacaaaagttagaatctgatgtctcagctcaaatggaatattgtcgcac

SEQ ID NO: 6589 - DNA, 201 bp, Homo sapiens
gcatggcacagatgatggtgtagtatggatgaattggaaggggtcatggtactcaatgaggaagatgagtatgaagatcaggcccttcttcccacagcaawagtccccaatacgtagatttttgctcttctgtatgtgacaacatttttgtacattatgttattggaattttctttcatacattatattcctctaaaactc

SEQ ID NO: 6590 - DNA, 201 bp, Homo sapiens
aaaagaggcagaagcaagtaaaagataatgaaaatgtagtcaatgagtactcctcagaactggaaaagcaccaattatatatagatgagactgtgaatagyaatatcccaactaaccttcgtgtgcttcgttcaatcctggaaaacctgagaagcaaaatacaaaagttagaatctgatgtctcagctcaaatggaatatt

SEQ ID NO: 6591 - DNA, 201 bp, Homo sapiens
tataatagatgtcatgcagccaatccaaacggcagatactactggggtggacagtacacctgggacatggcaaagcatggcacagatgatggtgtagtatrgatgaattggaaggggtcatggtactcaatgaggaagatgagtatgaagatcaggcccttcttcccacagcaatagtccccaatacgtagatttttgctc

SEQ ID NO: 6592 - DNA, 201 bp, Homo sapiens
gtataatagatgtcatgcagccaatccaaacggcagatactactggggtggacagtacacctgggacatggcaaagcatggcacagatgatggtgtagtakggatgaattggaaggggtcatggtactcaatgaggaagatgagtatgaagatcaggcccttcttcccacagcaatagtccccaatacgtagatttttgct

SEQ ID NO: 6593 - DNA, 113 bp, Homo sapiens
aaaggaaaaactgatgtttaaaagtccacttttaaaactatatttatttatgtaggatctgtcaaagaaaacttccaaaaagatttattaattaaaccagmctctgttgcaat

SEQ ID NO: 6594 - DNA, 201 bp, Homo sapiens
agacaatgacggctggttaacatcagatcccagaaaacagtgttctaaagaagacggtggtggatggtggtataatagatgtcatgcagccaatccaaacrgcagatactactggggtggacagtacacctgggacatggcaaagcatggcacagatgatggtgtagtatggatgaattggaaggggtcatggtactcaat

SEQ ID NO: 6595 - DNA, 201 bp, Homo sapiens
gaagccaacaaataccagatctcagtgaacaaatacagaggaacagccggtaatgccctcatggatggagcatctcagctgatgggagaaaacaggaccaygaccattcacaacggcatgttcttcagcacgtatgacagagacaatgacggctggttaacatcagatcccagaaaacagtgttctaaagaagacggtggt

SEQ ID NO: 6596 - DNA, 201 bp, Homo sapiens
tgtttcccagacctcctcttcttcctttcagtacatgtatttgctgaaagacctgtggcaaaagaggcagaagcaagtaaaagataatgaaaatgtagtcmatgagtactcctcagaactggaaaagcaccaattatatatagatgagactgtgaatagcaatatcccaactaaccttcgtgtgcttcgttcaatcctgga

SEQ ID NO: 6597 - DNA, 162 bp, Homo sapiens
aaataaggaagaggggtcttttatccttgtcgtaggaaaaccatgacggaaaggaaaaactgatgtttaaaagtccacttttaaaactatatttatttatrtaggatctgtcaaagaaaacttccaaaaagatttattaattaaaccagactctgttgcaat

SEQ ID NO: 6598 - DNA, 201 bp, Homo sapiens; identical to SEQ ID NO: 6570

SEQ ID NO: 6599 - DNA, 168 bp, Homo sapiens; identical to SEQ ID NO: 6571

SEQ ID NO: 6600 - DNA, 201 bp, Homo sapiens
gcccatcagtggaggtggctatcgggctcgtccagccaaagcagctgccactcaaaagaaagtagaaagaaaagcccctgatgctggaggctgtcttcacrctgagactgtgaatagcaatatcccaactaaccttcgtgtgcttcgttcaatcctggaaaacctgagaagcaaaatacaaaagttagaatctgatgtctc

SEQ ID NO: 6601 - DNA, 201 bp, Homo sapiens; identical to SEQ ID NO: 6572

SEQ ID NO: 6602 - DNA, 201 bp, Homo sapiens
tatcgggctcgtccagccaaagcagctgccactcaaaagaaagtagaaagaaaagcccctgatgctggaggctgtcttcacgctgagactgtgaatagcartatcccaactaaccttcgtgtgcttcgttcaatcctggaaaacctgagaagcaaaatacaaaagttagaatctgatgtctcagctcaaatggaatattgt

SEQ ID NO: 6603 - DNA, 201 bp, Homo sapiens; identical to SEQ ID NO: 6574

SEQ ID NO: 6604 - DNA, 201 bp, Homo sapiens
caaagcagctgccactcaaaagaaagtagaaagaaaagcccctgatgctggaggctgtcttcacgctgagactgtgaatagcaatatcccaactaaccttygtgtgcttcgttcaatcctggaaaacctgagaagcaaaatacaaaagttagaatctgatgtctcagctcaaatggaatattgtcgcaccccatgcactgt

SEQ ID NO: 6605 - DNA, 201 bp, Homo sapiens
ccatgaaacatctattattgctactattgtgtgtttttctagttaagtcccaaggtgtcaacgacaatgaggagggtttcttcagtgcccgtggtcatcgrccccttgacaagaagagagaagaggctcccagcctgaggcctgccccaccgcccatcagtggaggtggctatcgggctcgtccagccaaagcagctgcca

SEQ ID NO: 6606 - DNA, 201 bp, Homo sapiens
cgcccatcagtggaggtggctatcgggctcgtccagccaaagcagctgccactcaaaagaaagtagaaagaaaagcccctgatgctggaggctgtcttcaygctgagactgtgaatagcaatatcccaactaaccttcgtgtgcttcgttcaatcctggaaaacctgagaagcaaaatacaaaagttagaatctgatgtct

SEQ ID NO: 6607 - DNA, 201 bp, Homo sapiens; identical to SEQ ID NO: 6577

SEQ ID NO: 6608 - DNA, 201 bp, Homo sapiens; identical to SEQ ID NO: 6578

SEQ ID NO: 6609 - DNA, 201 bp, Homo sapiens
caaacttaaaaccatgaaacatctattattgctactattgtgtgtttttctagttaagtcccaaggtgtcaacgacaatgaggagggtttcttcagtgccygtggtcatcgaccccttgacaagaagagagaagaggctcccagcctgaggcctgccccaccgcccatcagtggaggtggctatcgggctcgtccagccaa

SEQ ID NO: 6610 - DNA, 201 bp, Homo sapiens; identical to SEQ ID NO: 6580

SEQ ID NO: 6611 - DNA, 201 bp, Homo sapiens; identical to SEQ ID NO: 6581

SEQ ID NO: 6612 - DNA, 201 bp, Homo sapiens
acttaaaaccatgaaacatctattattgctactattgtgtgtttttctagttaagtcccaaggtgtcaacgacaatgaggagggtttcttcagtgcccgtkgtcatcgaccccttgacaagaagagagaagaggctcccagcctgaggcctgccccaccgcccatcagtggaggtggctatcgggctcgtccagccaaagc

SEQ ID NO: 6613 - DNA, 201 bp, Homo sapiens; identical to SEQ ID NO: 6583

SEQ ID NO: 6614 - DNA, 201 bp, Homo sapiens; identical to SEQ ID NO: 6584

SEQ ID NO: 6615 - DNA, 201 bp, Homo sapiens
cttcagtgcccgtggtcatcgaccccttgacaagaagagagaagaggctcccagcctgaggcctgccccaccgcccatcagtggaggtggctatcgggctygtccagccaaagcagctgccactcaaaagaaagtagaaagaaaagcccctgatgctggaggctgtcttcacgctgagactgtgaatagcaatatcccaac

SEQ ID NO: 6616 - DNA, 201 bp, Homo sapiens; identical to SEQ ID NO: 6585

SEQ ID NO: 6617 - DNA, 201 bp, Homo sapiens
agaaagtagaaagaaaagcccctgatgctggaggctgtcttcacgctgagactgtgaatagcaatatcccaactaaccttcgtgtgcttcgttcaatcctrgaaaacctgagaagcaaaatacaaaagttagaatctgatgtctcagctcaaatggaatattgtcgcaccccatgcactgtcagttgcaatattcctgtgg

SEQ ID NO: 6618 - DNA, 201 bp, Homo sapiens; identical to SEQ ID NO: 6587

SEQ ID NO: 6619 - DNA, 201 bp, Homo sapiens
ggctcgtccagccaaagcagctgccactcaaaagaaagtagaaagaaaagcccctgatgctggaggctgtcttcacgctgagactgtgaatagcaatatcscaactaaccttcgtgtgcttcgttcaatcctggaaaacctgagaagcaaaatacaaaagttagaatctgatgtctcagctcaaatggaatattgtcgcac

SEQ ID NO: 6620 - DNA, 201 bp, Homo sapiens; identical to SEQ ID NO: 6589

SEQ ID NO: 6621 - DNA, 201 bp, Homo sapiens
gctatcgggctcgtccagccaaagcagctgccactcaaaagaaagtagaaagaaaagcccctgatgctggaggctgtcttcacgctgagactgtgaatagyaatatcccaactaaccttcgtgtgcttcgttcaatcctggaaaacctgagaagcaaaatacaaaagttagaatctgatgtctcagctcaaatggaatatt

SEQ ID NO: 6622 - DNA, 201 bp, Homo sapiens; identical to SEQ ID NO: 6591

SEQ ID NO: 6623 - DNA, 201 bp, Homo sapiens; identical to SEQ ID NO: 6592

SEQ ID NO: 6624 - DNA, 113 bp, Homo sapiens; identical to SEQ ID NO: 6593

SEQ ID NO: 6625 - DNA, 201 bp, Homo sapiens; identical to SEQ ID NO: 6594

SEQ ID NO: 6626 - DNA, 201 bp, Homo sapiens; identical to SEQ ID NO: 6595

SEQ ID NO: 6627 - DNA, 162 bp, Homo sapiens; identical to SEQ ID NO: 6597

SEQ ID NO: 6628 - DNA, 201 bp, Homo sapiens
ggctcccagcctgaggcctgccccaccgcccatcagtggaggtggctatcgggctcgtccagccaaagcagctgccactcaaaagaaagtagaaattgtgycctacaggatgtcagttgcaagaggctttgctacaacaggaaaggccaatcagaaatagtgttgatgagttaaataacaatgtggaagctgtttcccaga

SEQ ID NO: 6629 - DNA, 201 bp, Homo sapiens; identical to SEQ ID NO: 6570

SEQ ID NO: 6630 - DNA, 111 bp, Homo sapiens
agtctacatgraaaggatggtttcttggagcttccacaaacttaaaaccatgaaacatctattattgctactattgtgtgtttttctagttaagtcccaaggtgtcaacga

SEQ ID NO: 6631 - DNA, 201 bp, Homo sapiens; identical to SEQ ID NO: 6572

SEQ ID NO: 6632 - DNA, 201 bp, Homo sapiens; identical to SEQ ID NO: 6573

SEQ ID NO: 6633 - DNA, 201 bp, Homo sapiens; identical to SEQ ID NO: 6574

SEQ ID NO: 6634 - DNA, 201 bp, Homo sapiens; identical to SEQ ID NO: 6605

SEQ ID NO: 6635 - DNA, 201 bp, Homo sapiens; identical to SEQ ID NO: 6575

SEQ ID NO: 6636 - DNA, 201 bp, Homo sapiens; identical to SEQ ID NO: 6577

SEQ ID NO: 6637 - DNA, 201 bp, Homo sapiens; identical to SEQ ID NO: 6578

SEQ ID NO: 6638 - DNA, 201 bp, Homo sapiens; identical to SEQ ID NO: 6580

SEQ ID NO: 6639 - DNA, 201 bp, Homo sapiens; identical to SEQ ID NO: 6609

SEQ ID NO: 6640 - DNA, 201 bp, Homo sapiens; identical to SEQ ID NO: 6581

SEQ ID NO: 6641 - DNA, 201 bp, Homo sapiens; identical to SEQ ID NO: 6583

SEQ ID NO: 6642 - DNA, 201 bp, Homo sapiens; identical to SEQ ID NO: 6612

SEQ ID NO: 6643 - DNA, 201 bp, Homo sapiens; identical to SEQ ID NO: 6584

SEQ ID NO: 6644 - DNA, 201 bp, Homo sapiens; identical to SEQ ID NO: 6585

SEQ ID NO: 6645 - DNA, 201 bp, Homo sapiens
cttcagtgcccgtggtcatcgaccccttgacaagaagagagaagaggctcccagcctgaggcctgccccaccgcccatcagtggaggtggctatcgggctygtccagccaaagcagctgccactcaaaagaaagtagaaattgtgtcctacaggatgtcagttgcaagaggctttgctacaacaggaaaggccaatcagaa

SEQ ID NO: 6646 - DNA, 201 bp, Homo sapiens; identical to SEQ ID NO: 6586

SEQ ID NO: 6647 - DNA, 201 bp, Homo sapiens; identical to SEQ ID NO: 6587

SEQ ID NO: 6648 - DNA, 201 bp, Homo sapiens; identical to SEQ ID NO: 6588

SEQ ID NO: 6649 - DNA, 201 bp, Homo sapiens; identical to SEQ ID NO: 6589

SEQ ID NO: 6650 - DNA, 201 bp, Homo sapiens; identical to SEQ ID NO: 6590

SEQ ID NO: 6651 - DNA, 201 bp, Homo sapiens; identical to SEQ ID NO: 6591

SEQ ID NO: 6652 - DNA, 201 bp, Homo sapiens; identical to SEQ ID NO: 6592

SEQ ID NO: 6653 - DNA, 113 bp, Homo sapiens; identical to SEQ ID NO: 6593

SEQ ID NO: 6654 - DNA, 201 bp, Homo sapiens; identical to SEQ ID NO: 6594

SEQ ID NO: 6655 - DNA, 201 bp, Homo sapiens; identical to SEQ ID NO: 6595

SEQ ID NO: 6656 - DNA, 201 bp, Homo sapiens; identical to SEQ ID NO: 6596

SEQ ID NO: 6657 - DNA, 162 bp, Homo sapiens; identical to SEQ ID NO: 6597

SEQ ID NO: 6658 - DNA, 201 bp, Homo sapiens
gagaagaggctcccagcctgaggcctgccccaccgcccatcagtggaggtggctatcgggctcgtccagccaaagcagctgccactcaaaagaaattgtgycctacaggatgtcagttgcaagaggctttgctacaacaggaaaggccaatcagaaatagtgttgatgagttaaataacaatgtggaagctgtttcccaga

SEQ ID NO: 6659 - DNA, 201 bp, Homo sapiens; identical to SEQ ID NO: 6570

SEQ ID NO: 6660 - DNA, 201 bp, Homo sapiens; identical to SEQ ID NO: 6572

SEQ ID NO: 6661 - DNA, 201 bp, Homo sapiens; identical to SEQ ID NO: 6573

SEQ ID NO: 6662 - DNA, 201 bp, Homo sapiens; identical to SEQ ID NO: 6574

SEQ ID NO: 6663 - DNA, 201 bp, Homo sapiens; identical to SEQ ID NO: 6575

SEQ ID NO: 6664 - DNA, 201 bp, Homo sapiens; identical to SEQ ID NO: 6605

SEQ ID NO: 6665 - DNA, 201 bp, Homo sapiens; identical to SEQ ID NO: 6577

SEQ ID NO: 6666 - DNA, 201 bp, Homo sapiens; identical to SEQ ID NO: 6578

SEQ ID NO: 6667 - DNA, 201 bp, Homo sapiens; identical to SEQ ID NO: 6609

SEQ ID NO: 6668 - DNA, 201 bp, Homo sapiens; identical to SEQ ID NO: 6580

SEQ ID NO: 6669 - DNA, 201 bp, Homo sapiens; identical to SEQ ID NO: 6581

SEQ ID NO: 6670 - DNA, 201 bp, Homo sapiens; identical to SEQ ID NO: 6612

SEQ ID NO: 6671 - DNA, 201 bp, Homo sapiens; identical to SEQ ID NO: 6583

SEQ ID NO: 6672 - DNA, 201 bp, Homo sapiens; identical to SEQ ID NO: 6584

SEQ ID NO: 6673 - DNA, 201 bp, Homo sapiens
cttcagtgcccgtggtcatcgaccccttgacaagaagagagaagaggctcccagcctgaggcctgccccaccgcccatcagtggaggtggctatcgggctygtccagccaaagcagctgccactcaaaagaaattgtgtcctacaggatgtcagttgcaagaggctttgctacaacaggaaaggccaatcagaaatagtgt

SEQ ID NO: 6674 - DNA, 201 bp, Homo sapiens; identical to SEQ ID NO: 6585

SEQ ID NO: 6675 - DNA, 201 bp, Homo sapiens; identical to SEQ ID NO: 6586

SEQ ID NO: 6676 - DNA, 201 bp, Homo sapiens; identical to SEQ ID NO: 6587

SEQ ID NO: 6677 - DNA, 201 bp, Homo sapiens; identical to SEQ ID NO: 6588

SEQ ID NO: 6678 - DNA, 201 bp, Homo sapiens; identical to SEQ ID NO: 6589

SEQ ID NO: 6679 - DNA, 201 bp, Homo sapiens; identical to SEQ ID NO: 6590

SEQ ID NO: 6680 - DNA, 201 bp, Homo sapiens; identical to SEQ ID NO: 6591

SEQ ID NO: 6681 - DNA, 201 bp, Homo sapiens; identical to SEQ ID NO: 6592

SEQ ID NO: 6682 - DNA, 113 bp, Homo sapiens; identical to SEQ ID NO: 6593

SEQ ID NO: 6683 - DNA, 201 bp, Homo sapiens; identical to SEQ ID NO: 6594

SEQ ID NO: 6684 - DNA, 201 bp, Homo sapiens; identical to SEQ ID NO: 6595

SEQ ID NO: 6685 - DNA, 201 bp, Homo sapiens; identical to SEQ ID NO: 6596

SEQ ID NO: 6686 - DNA, 162 bp, Homo sapiens; identical to SEQ ID NO: 6597

SEQ ID NO: 6687 - DNA, 201 bp, Homo sapiens
ctcgtccagccaaagcagctgccactcaaaagaaagtagaaagaaaagcccctgatgctggaggctgtcttcacgctgacccagacctgggggtgttgtgycctacaggatgtcagttgcaagaggctttgctacaacaggaaaggccaatcagaaatagtgttgatgagttaaataacaatgtggaagctgtttcccaga

SEQ ID NO: 6688 - DNA, 201 bp, Homo sapiens
gcaatattcctgtggtgtctggcaaagaatgtgaggaaattatcaggaaaggaggtgaaacatctgaaatgtatctcattcaacctgacagttctgtcaaygatggacagtgattcagaaccgtcaagacggtagtgttgactttggcaggaaatgggatccatataaacagggatttggaaatgttgcaaccaacacaga

SEQ ID NO: 6689 - DNA, 201 bp, Homo sapiens
gtggtgtctggcaaagaatgtgaggaaattatcaggaaaggaggtgaaacatctgaaatgtatctcattcaacctgacagttctgtcaaagatggacagtkattcagaaccgtcaagacggtagtgttgactttggcaggaaatgggatccatataaacagggatttggaaatgttgcaaccaacacagatgggaagaatt

SEQ ID NO: 6690 - DNA, 201 bp, Homo sapiens
gcccatcagtggaggtggctatcgggctcgtccagccaaagcagctgccactcaaaagaaagtagaaagaaaagcccctgatgctggaggctgtcttcacrctgacccagacctgggggtgttgtgtcctacaggatgtcagttgcaagaggctttgctacaacaggaaaggccaatcagaaatagtgttgatgagttaaa

SEQ ID NO: 6691 - DNA, 201 bp, Homo sapiens; identical to SEQ ID NO: 6574

SEQ ID NO: 6692 - DNA, 201 bp, Homo sapiens
aagaggcagaagcaagtaaaagataatgaaaatgtagtcaatgagtactcctcagaactggaaaagcaccaattatatatagatgagactgtgaatagcartatcccaactaaccttcgtgtgcttcgttcaatcctggaaaacctgagaagcaaaatacaaaatgtcagttgcaatattcctgtggtgtctggcaaagaa

SEQ ID NO: 6693 - DNA, 201 bp, Homo sapiens
aaaagataatgaaaatgtagtcaatgagtactcctcagaactggaaaagcaccaattatatatagatgagactgtgaatagcaatatcccaactaaccttygtgtgcttcgttcaatcctggaaaacctgagaagcaaaatacaaaatgtcagttgcaatattcctgtggtgtctggcaaagaatgtgaggaaattatcag

SEQ ID NO: 6694 - DNA, 201 bp, Homo sapiens; identical to SEQ ID NO: 6605

SEQ ID NO: 6695 - DNA, 201 bp, Homo sapiens
caaagaatgtgaggaaattatcaggaaaggaggtgaaacatctgaaatgtatctcattcaacctgacagttctgtcaaagatggacagtgattcagaaccrtcaagacggtagtgttgactttggcaggaaatgggatccatataaacagggatttggaaatgttgcaaccaacacagatgggaagaattactgtggccta

SEQ ID NO: 6696 - DNA, 201 bp, Homo sapiens
cgcccatcagtggaggtggctatcgggctcgtccagccaaagcagctgccactcaaaagaaagtagaaagaaaagcccctgatgctggaggctgtcttcaygctgacccagacctgggggtgttgtgtcctacaggatgtcagttgcaagaggctttgctacaacaggaaaggccaatcagaaatagtgttgatgagttaa

SEQ ID NO: 6697 - DNA, 201 bp, Homo sapiens; identical to SEQ ID NO: 6578

SEQ ID NO: 6698 - DNA, 201 bp, Homo sapiens; identical to SEQ ID NO: 6609

SEQ ID NO: 6699 - DNA, 201 bp, Homo sapiens; identical to SEQ ID NO: 6580

SEQ ID NO: 6700 - DNA, 201 bp, Homo sapiens; identical to SEQ ID NO: 6612

SEQ ID NO: 6701 - DNA, 201 bp, Homo sapiens; identical to SEQ ID NO: 6581

SEQ ID NO: 6702 - DNA, 201 bp, Homo sapiens; identical to SEQ ID NO: 6583

SEQ ID NO: 6703 - DNA, 201 bp, Homo sapiens
cttcagtgcccgtggtcatcgaccccttgacaagaagagagaagaggctcccagcctgaggcctgccccaccgcccatcagtggaggtggctatcgggctygtccagccaaagcagctgccactcaaaagaaagtagaaagaaaagcccctgatgctggaggctgtcttcacgctgacccagacctgggggtgttgtgtcc

SEQ ID NO: 6704 - DNA, 201 bp, Homo sapiens; identical to SEQ ID NO: 6584

SEQ ID NO: 6705 - DNA, 201 bp, Homo sapiens; identical to SEQ ID NO: 6585

SEQ ID NO: 6706 - DNA, 201 bp, Homo sapiens; identical to SEQ ID NO: 6587

SEQ ID NO: 6707 - DNA, 201 bp, Homo sapiens
tcaatgagtactcctcagaactggaaaagcaccaattatatatagatgagactgtgaatagcaatatcccaactaaccttcgtgtgcttcgttcaatcctrgaaaacctgagaagcaaaatacaaaatgtcagttgcaatattcctgtggtgtctggcaaagaatgtgaggaaattatcaggaaaggaggtgaaacatctg

SEQ ID NO: 6708 - DNA, 201 bp, Homo sapiens; identical to SEQ ID NO: 6589

SEQ ID NO: 6709 - DNA, 201 bp, Homo sapiens
gcagaagcaagtaaaagataatgaaaatgtagtcaatgagtactcctcagaactggaaaagcaccaattatatatagatgagactgtgaatagcaatatcscaactaaccttcgtgtgcttcgttcaatcctggaaaacctgagaagcaaaatacaaaatgtcagttgcaatattcctgtggtgtctggcaaagaatgtga

SEQ ID NO: 6710 - DNA, 201 bp, Homo sapiens
aaaagaggcagaagcaagtaaaagataatgaaaatgtagtcaatgagtactcctcagaactggaaaagcaccaattatatatagatgagactgtgaatagyaatatcccaactaaccttcgtgtgcttcgttcaatcctggaaaacctgagaagcaaaatacaaaatgtcagttgcaatattcctgtggtgtctggcaaag

SEQ ID NO: 6711 - DNA, 201 bp, Homo sapiens; identical to SEQ ID NO: 6591

SEQ ID NO: 6712 - DNA, 103 bp, Homo sapiens
aaaggaaaaactgatgtttaaaagtccacttttaaaactatatttatttatgtaggatctgtcaaagaaaacttccaaaaagatttattaattaaaccagmct

SEQ ID NO: 6713 - DNA, 201 bp, Homo sapiens; identical to SEQ ID NO: 6592

SEQ ID NO: 6714 - DNA, 201 bp, Homo sapiens; identical to SEQ ID NO: 6594

SEQ ID NO: 6715 - DNA, 201 bp, Homo sapiens; identical to SEQ ID NO: 6595

SEQ ID NO: 6716 - DNA, 201 bp, Homo sapiens
cagtggaggtggctatcgggctcgtccagccaaagcagctgccactcaaaagaaagtagaaagaaaagcccctgatgctggaggctgtcttcacgctgacycagacctgggggtgttgtgtcctacaggatgtcagttgcaagaggctttgctacaacaggaaaggccaatcagaaatagtgttgatgagttaaataacaa

SEQ ID NO: 6717 - DNA, 152 bp, Homo sapiens
aaataaggaagaggggtcttttatccttgtcgtaggaaaaccatgacggaaaggaaaaactgatgtttaaaagtccacttttaaaactatatttatttatrtaggatctgtcaaagaaaacttccaaaaagatttattaattaaaccagact

SEQ ID NO: 6718 - DNA, 201 bp, Homo sapiens; identical to SEQ ID NO: 6596

SEQ ID NO: 6719 - DNA, 201 bp, Homo sapiens
ttgattccaacagggatggcgccttgtccaagaagagacccagagccagtgaatgggacatagggtttatttaggacttaaatacagatgtggtccagtgkcagtgggctggacaggaccgctactatttgtaaagagtatgtagtttatataacatttctacttagcactctccacttagcaacctccatttaacccaaa

SEQ ID NO: 6720 - DNA, 201 bp, Homo sapiens; identical to SEQ ID NO: 6690

SEQ ID NO: 6721 - DNA, 168 bp, Homo sapiens; identical to SEQ ID NO: 6571

SEQ ID NO: 6722 - DNA, 201 bp, Homo sapiens; identical to SEQ ID NO: 6573

SEQ ID NO: 6723 - DNA, 201 bp, Homo sapiens; identical to SEQ ID NO: 6575

SEQ ID NO: 6724 - DNA, 201 bp, Homo sapiens; identical to SEQ ID NO: 6605

SEQ ID NO: 6725 - DNA, 201 bp, Homo sapiens; identical to SEQ ID NO: 6577

SEQ ID NO: 6726 - DNA, 201 bp, Homo sapiens; identical to SEQ ID NO: 6696

SEQ ID NO: 6727 - DNA, 201 bp, Homo sapiens; identical to SEQ ID NO: 6578

SEQ ID NO: 6728 - DNA, 201 bp, Homo sapiens; identical to SEQ ID NO: 6580

SEQ ID NO: 6729 - DNA, 201 bp, Homo sapiens
ttcttaaattcaaattttttagctggagtaaaaatggtcccagtaccatttcctgttcccttcactataacctacatttttgtcacattaagtttttcccyattccaggacaggtcaggccctttaaaaatttcaacagctttattgagatataattgatataatttaaaaaatcctgcacatgtgtcatgctggagccct

SEQ ID NO: 6730 - DNA, 201 bp, Homo sapiens; identical to SEQ ID NO: 6581

SEQ ID NO: 6731 - DNA, 201 bp, Homo sapiens; identical to SEQ ID NO: 6583

SEQ ID NO: 6732 - DNA, 201 bp, Homo sapiens; identical to SEQ ID NO: 6584

SEQ ID NO: 6733 - DNA, 201 bp, Homo sapiens; identical to SEQ ID NO: 6585

SEQ ID NO: 6734 - DNA, 201 bp, Homo sapiens
tggcagtgggctggacaggaccgctactatttgtaaagagtatgtagtttatataacatttctacttagcactctccacttagcaacctccatttaacccmaaataaaaggccttggttccttgcacatcctgagttccaacggacaggcagggagttcaagtgtccttcacagataagaagtgaatctctctgggttggc

SEQ ID NO: 6735 - DNA, 201 bp, Homo sapiens; identical to SEQ ID NO: 6587

SEQ ID NO: 6736 - DNA, 201 bp, Homo sapiens; identical to SEQ ID NO: 6586

SEQ ID NO: 6737 - DNA, 201 bp, Homo sapiens; identical to SEQ ID NO: 6588

SEQ ID NO: 6738 - DNA, 201 bp, Homo sapiens; identical to SEQ ID NO: 6589

SEQ ID NO: 6739 - DNA, 201 bp, Homo sapiens; identical to SEQ ID NO: 6590

SEQ ID NO: 6740 - DNA, 201 bp, Homo sapiens; identical to SEQ ID NO: 6591

SEQ ID NO: 6741 - DNA, 201 bp, Homo sapiens; identical to SEQ ID NO: 6592

SEQ ID NO: 6742 - DNA, 201 bp, Homo sapiens
tgctactactctctttaattactcaccaaatccaactttaacttttgacctggtttctctgccacaagttctgtcccactggagcccatactcacctaccrctttgccatcacatttaacagaaaactcttatcaacttacttcctgcttaacattagctccttcctatctatatccaaatttcttaaattcaaatttttt

SEQ ID NO: 6743 - DNA, 201 bp, Homo sapiens
caaatagctaataaaccggtcttgaatatttgaagatttaaaatctgactctaggacgggcacggtggctcacgactataatcccaacactttgggaggcygaggcgggcggtcacaaggtcaggagttcaagaccagcctgaccaatatggtgaaaccccatctctactaaaaatacaaaaattagccaggcgtggtggc

SEQ ID NO: 6744 - DNA, 201 bp, Homo sapiens
aaaggaaaaactgatgtttaaaagtccacttttaaaactatatttatttatgtaggatctgtcaaagaaaacttccaaaaagatttattaattaaaccagmctctgttgcaataagttaatgttttcttgttttgtaatccacacattcaatgagttaggctttgcacttgtaaggaaggagaagcgttcacaacctcaaa

SEQ ID NO: 6745 - DNA, 201 bp, Homo sapiens; identical to SEQ ID NO: 6594

SEQ ID NO: 6746 - DNA, 201 bp, Homo sapiens
taacctacatttttgtcacattaagtttttccccattccaggacaggtcaggccctttaaaaatttcaacagctttattgagatataattgatataatttwaaaaatcctgcacatgtgtcatgctggagccctattgattccaacagggatggcgccttgtccaagaagagacccagagccagtgaatgggacatagggt

SEQ ID NO: 6747 - DNA, 201 bp, Homo sapiens; identical to SEQ ID NO: 6595

SEQ ID NO: 6748 - DNA, 201 bp, Homo sapiens; identical to SEQ ID NO: 6596

SEQ ID NO: 6749 - DNA, 201 bp, Homo sapiens
ccacttttaaaactatatttatttatgtaggatctgtcaaagaaaacttccaaaaagatttattaattaaaccagactctgttgcaataagttaatgtttycttgttttgtaatccacacattcaatgagttaggctttgcacttgtaaggaaggagaagcgttcacaacctcaaatagctaataaaccggtcttgaatat

SEQ ID NO: 6750 - DNA, 201 bp, Homo sapiens
caaaaaaaaaaaaaaaagaatctgactatataccatggaaaagccaccactctgccacttaaataaacatcaggatcagagattccaagaggacaatctgsatcaagtcttcaccaagtgttttttaagcgaaataatgaaatagggagcagaatatgcctgttgcccatagaaacgaggtctattcttgtcctcaattag

SEQ ID NO: 6751 - DNA, 201 bp, Homo sapiens
aatatgcctgttgcccatagaaacgaggtctattcttgtcctcaattaggcttttttttcttcatagttacaccagaactaaagtaaaagtggtttttctsttctttctacttctccccatgaaatgggcatatcatctcaacacttcactccaagtcgccacgggcaaccttatgaccctaggtcctccacccctaatgt

SEQ ID NO: 6752 - DNA, 201 bp, Homo sapiens; identical to SEQ ID NO: 6687

SEQ ID NO: 6753 - DNA, 201 bp, Homo sapiens; identical to SEQ ID NO: 6570

SEQ ID NO: 6754 - DNA, 201 bp, Homo sapiens; identical to SEQ ID NO: 6572

SEQ ID NO: 6755 - DNA, 201 bp, Homo sapiens; identical to SEQ ID NO: 6574

SEQ ID NO: 6756 - DNA, 201 bp, Homo sapiens
ttaacattagctccttcctatctatatccaaatttcttaaattcaaattttttagctggagtaaaaatggtcccagtaccatttcctgttcccttcactayaacctacatttttgtcacattaagtttttccccattccaggacaggtcaggccctttaaaaatttcaacagctttattgagatataattgatataattta

SEQ ID NO: 6757 - DNA, 201 bp, Homo sapiens; identical to SEQ ID NO: 6609

SEQ ID NO: 6758 - DNA, 201 bp, Homo sapiens; identical to SEQ ID NO: 6612

SEQ ID NO: 6759 - DNA, 201 bp, Homo sapiens; identical to SEQ ID NO: 6703

SEQ ID NO: 6760 - DNA, 201 bp, Homo sapiens; identical to SEQ ID NO: 6716

SEQ ID NO: 6761 - DNA, 201 bp, Homo sapiens
aaataaggaagaggggtcttttatccttgtcgtaggaaaaccatgacggaaaggaaaaactgatgtttaaaagtccacttttaaaactatatttatttatrtaggatctgtcaaagaaaacttccaaaaagatttattaattaaaccagactctgttgcaataagttaatgttttcttgttttgtaatccacacattcaat

SEQ ID NO: 6762 - DNA, 201 bp, Homo sapiens
aagtccacttttaaaactatatttatttatgtaggatctgtcaaagaaaacttccaaaaagatttattaattaaaccagactctgttgcaataagttaatrttttcttgttttgtaatccacacattcaatgagttaggctttgcacttgtaaggaaggagaagcgttcacaacctcaaatagctaataaaccggtcttga

SEQ ID NO: 6763 - DNA, 201 bp, Homo sapiens; identical to SEQ ID NO: 6628

SEQ ID NO: 6764 - DNA, 201 bp, Homo sapiens; identical to SEQ ID NO: 6570

SEQ ID NO: 6765 - DNA, 201 bp, Homo sapiens; identical to SEQ ID NO: 6572

SEQ ID NO: 6766 - DNA, 201 bp, Homo sapiens; identical to SEQ ID NO: 6573

SEQ ID NO: 6767 - DNA, 201 bp, Homo sapiens; identical to SEQ ID NO: 6574

SEQ ID NO: 6768 - DNA, 201 bp, Homo sapiens
tgagggtgttggaatagttacattccaaatcttctataacactctgtattatatttctgcctcattccttgtagggtttcttcagtgcccgtggtcatcgrccccttgacaagaagagagaagaggctcccagcctgaggcctgccccaccgcccatcagtggaggtggctatcgggctcgtccagccaaagcagctgcca

SEQ ID NO: 6769 - DNA, 201 bp, Homo sapiens; identical to SEQ ID NO: 6575

SEQ ID NO: 6770 - DNA, 201 bp, Homo sapiens; identical to SEQ ID NO: 6577

SEQ ID NO: 6771 - DNA, 201 bp, Homo sapiens; identical to SEQ ID NO: 6578

SEQ ID NO: 6772 - DNA, 201 bp, Homo sapiens; identical to SEQ ID NO: 6580

SEQ ID NO: 6773 - DNA, 201 bp, Homo sapiens
aaattataaaatgagggtgttggaatagttacattccaaatcttctataacactctgtattatatttctgcctcattccttgtagggtttcttcagtgccygtggtcatcgaccccttgacaagaagagagaagaggctcccagcctgaggcctgccccaccgcccatcagtggaggtggctatcgggctcgtccagccaa

SEQ ID NO: 6774 - DNA, 201 bp, Homo sapiens; identical to SEQ ID NO: 6581

SEQ ID NO: 6775 - DNA, 201 bp, Homo sapiens; identical to SEQ ID NO: 6583

SEQ ID NO: 6776 - DNA, 201 bp, Homo sapiens
ttataaaatgagggtgttggaatagttacattccaaatcttctataacactctgtattatatttctgcctcattccttgtagggtttcttcagtgcccgtkgtcatcgaccccttgacaagaagagagaagaggctcccagcctgaggcctgccccaccgcccatcagtggaggtggctatcgggctcgtccagccaaagc

SEQ ID NO: 6777 - DNA, 201 bp, Homo sapiens; identical to SEQ ID NO: 6584

SEQ ID NO: 6778 - DNA, 201 bp, Homo sapiens; identical to SEQ ID NO: 6585

SEQ ID NO: 6779 - DNA, 201 bp, Homo sapiens; identical to SEQ ID NO: 6645

SEQ ID NO: 6780 - DNA, 201 bp, Homo sapiens; identical to SEQ ID NO: 6586

SEQ ID NO: 6781 - DNA, 201 bp, Homo sapiens; identical to SEQ ID NO: 6587

SEQ ID NO: 6782 - DNA, 201 bp, Homo sapiens; identical to SEQ ID NO: 6588

SEQ ID NO: 6783 - DNA, 201 bp, Homo sapiens; identical to SEQ ID NO: 6589

SEQ ID NO: 6784 - DNA, 201 bp, Homo sapiens; identical to SEQ ID NO: 6590

SEQ ID NO: 6785 - DNA, 201 bp, Homo sapiens; identical to SEQ ID NO: 6591

SEQ ID NO: 6786 - DNA, 201 bp, Homo sapiens; identical to SEQ ID NO: 6592

SEQ ID NO: 6787 - DNA, 113 bp, Homo sapiens; identical to SEQ ID NO: 6593

SEQ ID NO: 6788 - DNA, 201 bp, Homo sapiens; identical to SEQ ID NO: 6594

SEQ ID NO: 6789 - DNA, 201 bp, Homo sapiens; identical to SEQ ID NO: 6595

SEQ ID NO: 6790 - DNA, 201 bp, Homo sapiens; identical to SEQ ID NO: 6596

SEQ ID NO: 6791 - DNA, 162 bp, Homo sapiens; identical to SEQ ID NO: 6597

SEQ ID NO: 6792 - DNA, 201 bp, Homo sapiens; identical to SEQ ID NO: 6690

SEQ ID NO: 6793 - DNA, 168 bp, Homo sapiens; identical to SEQ ID NO: 6571

SEQ ID NO: 6794 - DNA, 201 bp, Homo sapiens; identical to SEQ ID NO: 6573

SEQ ID NO: 6795 - DNA, 201 bp, Homo sapiens; identical to SEQ ID NO: 6575

SEQ ID NO: 6796 - DNA, 201 bp, Homo sapiens; identical to SEQ ID NO: 6605

SEQ ID NO: 6797 - DNA, 201 bp, Homo sapiens; identical to SEQ ID NO: 6577

SEQ ID NO: 6798 - DNA, 201 bp, Homo sapiens; identical to SEQ ID NO: 6696

SEQ ID NO: 6799 - DNA, 201 bp, Homo sapiens; identical to SEQ ID NO: 6578

SEQ ID NO: 6800 - DNA, 201 bp, Homo sapiens; identical to SEQ ID NO: 6580

SEQ ID NO: 6801 - DNA, 201 bp, Homo sapiens
agatactactggggtggacagtacacctgggacatggcaaagcatggcacagatgatggtgtagtatggatgaattggaaggggtcatggtactcaatgargaagatgaatttttgctcttctgtatgtgacaacatttttgtacattatgttattggaattttctttcatacattatattcctctaaaactctcaagcag

SEQ ID NO: 6802 - DNA, 201 bp, Homo sapiens; identical to SEQ ID NO: 6583

SEQ ID NO: 6803 - DNA, 201 bp, Homo sapiens; identical to SEQ ID NO: 6584

SEQ ID NO: 6804 - DNA, 201 bp, Homo sapiens; identical to SEQ ID NO: 6585

SEQ ID NO: 6805 - DNA, 201 bp, Homo sapiens
tgtcatgcagccaatccaaacggcagatactactggggtggacagtacacctgggacatggcaaagcatggcacagatgatggtgtagtatggatgaattrgaaggggtcatggtactcaatgaggaagatgaatttttgctcttctgtatgtgacaacatttttgtacattatgttattggaattttctttcatacatta

SEQ ID NO: 6806 - DNA, 201 bp, Homo sapiens; identical to SEQ ID NO: 6586

SEQ ID NO: 6807 - DNA, 201 bp, Homo sapiens; identical to SEQ ID NO: 6588

SEQ ID NO: 6808 - DNA, 201 bp, Homo sapiens; identical to SEQ ID NO: 6590

SEQ ID NO: 6809 - DNA, 201 bp, Homo sapiens
tataatagatgtcatgcagccaatccaaacggcagatactactggggtggacagtacacctgggacatggcaaagcatggcacagatgatggtgtagtatrgatgaattggaaggggtcatggtactcaatgaggaagatgaatttttgctcttctgtatgtgacaacatttttgtacattatgttattggaattttcttt

SEQ ID NO: 6810 - DNA, 201 bp, Homo sapiens
gtataatagatgtcatgcagccaatccaaacggcagatactactggggtggacagtacacctgggacatggcaaagcatggcacagatgatggtgtagtakggatgaattggaaggggtcatggtactcaatgaggaagatgaatttttgctcttctgtatgtgacaacatttttgtacattatgttattggaattttctt

SEQ ID NO: 6811 - DNA, 201 bp, Homo sapiens; identical to SEQ ID NO: 6743

SEQ ID NO: 6812 - DNA, 201 bp, Homo sapiens; identical to SEQ ID NO: 6744

SEQ ID NO: 6813 - DNA, 201 bp, Homo sapiens; identical to SEQ ID NO: 6594

SEQ ID NO: 6814 - DNA, 201 bp, Homo sapiens; identical to SEQ ID NO: 6595

SEQ ID NO: 6815 - DNA, 201 bp, Homo sapiens; identical to SEQ ID NO: 6596

SEQ ID NO: 6816 - DNA, 201 bp, Homo sapiens; identical to SEQ ID NO: 6749

SEQ ID NO: 6817 - DNA, 201 bp, Homo sapiens; identical to SEQ ID NO: 6750

SEQ ID NO: 6818 - DNA, 201 bp, Homo sapiens; identical to SEQ ID NO: 6687

SEQ ID NO: 6819 - DNA, 201 bp, Homo sapiens; identical to SEQ ID NO: 6570

SEQ ID NO: 6820 - DNA, 201 bp, Homo sapiens; identical to SEQ ID NO: 6572

SEQ ID NO: 6821 - DNA, 201 bp, Homo sapiens; identical to SEQ ID NO: 6574

SEQ ID NO: 6822 - DNA, 201 bp, Homo sapiens; identical to SEQ ID NO: 6609

SEQ ID NO: 6823 - DNA, 201 bp, Homo sapiens; identical to SEQ ID NO: 6612

SEQ ID NO: 6824 - DNA, 201 bp, Homo sapiens; identical to SEQ ID NO: 6703

SEQ ID NO: 6825 - DNA, 201 bp, Homo sapiens; identical to SEQ ID NO: 6716

SEQ ID NO: 6826 - DNA, 201 bp, Homo sapiens; identical to SEQ ID NO: 6761

SEQ ID NO: 6827 - DNA, 201 bp, Homo sapiens; identical to SEQ ID NO: 6762

SEQ ID NO: 6828 - DNA, 201 bp, Homo sapiens; identical to SEQ ID NO: 6687

SEQ ID NO: 6829 - DNA, 201 bp, Homo sapiens; identical to SEQ ID NO: 6570

SEQ ID NO: 6830 - DNA, 201 bp, Homo sapiens; identical to SEQ ID NO: 6690

SEQ ID NO: 6831 - DNA, 201 bp, Homo sapiens; identical to SEQ ID NO: 6572

SEQ ID NO: 6832 - DNA, 168 bp, Homo sapiens; identical to SEQ ID NO: 6571

SEQ ID NO: 6833 - DNA, 201 bp, Homo sapiens; identical to SEQ ID NO: 6573

SEQ ID NO: 6834 - DNA, 201 bp, Homo sapiens; identical to SEQ ID NO: 6574

SEQ ID NO: 6835 - DNA, 201 bp, Homo sapiens; identical to SEQ ID NO: 6605

SEQ ID NO: 6836 - DNA, 201 bp, Homo sapiens; identical to SEQ ID NO: 6575

SEQ ID NO: 6837 - DNA, 201 bp, Homo sapiens; identical to SEQ ID NO: 6696

SEQ ID NO: 6838 - DNA, 201 bp, Homo sapiens; identical to SEQ ID NO: 6577

SEQ ID NO: 6839 - DNA, 201 bp, Homo sapiens; identical to SEQ ID NO: 6578

SEQ ID NO: 6840 - DNA, 201 bp, Homo sapiens; identical to SEQ ID NO: 6609

SEQ ID NO: 6841 - DNA, 201 bp, Homo sapiens; identical to SEQ ID NO: 6580

SEQ ID NO: 6842 - DNA, 201 bp, Homo sapiens; identical to SEQ ID NO: 6612

SEQ ID NO: 6843 - DNA, 201 bp, Homo sapiens; identical to SEQ ID NO: 6583

SEQ ID NO: 6844 - DNA, 139 bp, Homo sapiens
agatactactggggtggacagtacacctgggacatggcaaagcatggcacagatgatggtgtagtatggatgaattggaaggggtcatggtactcaatgargaagatgagtatgaagatcaggcccttcttcccacagc

SEQ ID NO: 6845 - DNA, 201 bp, Homo sapiens; identical to SEQ ID NO: 6584

SEQ ID NO: 6846 - DNA, 201 bp, Homo sapiens; identical to SEQ ID NO: 6703

SEQ ID NO: 6847 - DNA, 201 bp, Homo sapiens; identical to SEQ ID NO: 6586

SEQ ID NO: 6848 - DNA, 163 bp, Homo sapiens
ccagaaaacaccaatccaaacggcagatactactggggtggacagtacacctgggacatggcaaagcatggcacagatgatggtgtagtatggatgaattrgaaggggtcatggtactcaatgaggaagatgagtatgaagatcaggcccttcttcccacagc

SEQ ID NO: 6849 - DNA, 201 bp, Homo sapiens; identical to SEQ ID NO: 6588

SEQ ID NO: 6850 - DNA, 201 bp, Homo sapiens; identical to SEQ ID NO: 6590

SEQ ID NO: 6851 - DNA, 172 bp, Homo sapiens
catcagatcccagaaaacaccaatccaaacggcagatactactggggtggacagtacacctgggacatggcaaagcatggcacagatgatggtgtagtatrgatgaattggaaggggtcatggtactcaatgaggaagatgagtatgaagatcaggcccttcttcccacagc

SEQ ID NO: 6852 - DNA, 173 bp, Homo sapiens
acatcagatcccagaaaacaccaatccaaacggcagatactactggggtggacagtacacctgggacatggcaaagcatggcacagatgatggtgtagtakggatgaattggaaggggtcatggtactcaatgaggaagatgagtatgaagatcaggcccttcttcccacagc

SEQ ID NO: 6853 - DNA, 201 bp, Homo sapiens
aacaggaccatgaccattcacaacggcatgttcttcagcacgtatgacagagacaatgacggctggttaacatcagatcccagaaaacaccaatccaaacrgcagatactactggggtggacagtacacctgggacatggcaaagcatggcacagatgatggtgtagtatggatgaattggaaggggtcatggtactcaat

SEQ ID NO: 6854 - DNA, 201 bp, Homo sapiens
gaagccaacaaataccagatctcagtgaacaaatacagaggaacagccggtaatgccctcatggatggagcatctcagctgatgggagaaaacaggaccaygaccattcacaacggcatgttcttcagcacgtatgacagagacaatgacggctggttaacatcagatcccagaaaacaccaatccaaacggcagatacta

SEQ ID NO: 6855 - DNA, 201 bp, Homo sapiens; identical to SEQ ID NO: 6716

SEQ ID NO: 6856 - DNA, 201 bp, Homo sapiens; identical to SEQ ID NO: 6596

SEQ ID NO: 6857 - DNA, 201 bp, Homo sapiens
gtgcccgtggtcatcgaccccttgacaagaagagagaagaggctcccacccctgatgctggaggctgtcttcacgctgacccagacctgggggtgttgtgycctacaggatgtcagttgcaagaggctttgctacaacaggaaaggccaatcagaaatagtgttgatgagttaaataacaatgtggaagctgtttcccaga

SEQ ID NO: 6858 - DNA, 201 bp, Homo sapiens
aatattcctgtggtgtctggcaaagaatgtgaggaaattatcaggaaaggaggtgaaacatctgaaatgtatctcattcaacctgacagttctgtcaaacygtatagagtatactgtgacatgaatacagaaaatggagggatggacagtgattcagaaccgtcaagacggtagtgttgactttggcaggaaatgggatcc

SEQ ID NO: 6859 - DNA, 201 bp, Homo sapiens
aggtgaaacatctgaaatgtatctcattcaacctgacagttctgtcaaaccgtatagagtatactgtgacatgaatacagaaaatggagggatggacagtkattcagaaccgtcaagacggtagtgttgactttggcaggaaatgggatccatataaacagggatttggaaatgttgcaaccaacacagatgggaagaatt

SEQ ID NO: 6860 - DNA, 201 bp, Homo sapiens
caacgacaatgaggagggtttcttcagtgcccgtggtcatcgaccccttgacaagaagagagaagaggctcccacccctgatgctggaggctgtcttcacrctgacccagacctgggggtgttgtgtcctacaggatgtcagttgcaagaggctttgctacaacaggaaaggccaatcagaaatagtgttgatgagttaaa

SEQ ID NO: 6861 - DNA, 168 bp, Homo sapiens; identical to SEQ ID NO: 6571

SEQ ID NO: 6862 - DNA, 201 bp, Homo sapiens; identical to SEQ ID NO: 6574

SEQ ID NO: 6863 - DNA, 201 bp, Homo sapiens; identical to SEQ ID NO: 6573

SEQ ID NO: 6864 - DNA, 201 bp, Homo sapiens; identical to SEQ ID NO: 6575

SEQ ID NO: 6865 - DNA, 201 bp, Homo sapiens
ccatgaaacatctattattgctactattgtgtgtttttctagttaagtcccaaggtgtcaacgacaatgaggagggtttcttcagtgcccgtggtcatcgrccccttgacaagaagagagaagaggctcccacccctgatgctggaggctgtcttcacgctgacccagacctgggggtgttgtgtcctacaggatgtcagt

SEQ ID NO: 6866 - DNA, 201 bp, Homo sapiens
tcaacgacaatgaggagggtttcttcagtgcccgtggtcatcgaccccttgacaagaagagagaagaggctcccacccctgatgctggaggctgtcttcaygctgacccagacctgggggtgttgtgtcctacaggatgtcagttgcaagaggctttgctacaacaggaaaggccaatcagaaatagtgttgatgagttaa

SEQ ID NO: 6867 - DNA, 201 bp, Homo sapiens
ctgaaatgtatctcattcaacctgacagttctgtcaaaccgtatagagtatactgtgacatgaatacagaaaatggagggatggacagtgattcagaaccrtcaagacggtagtgttgactttggcaggaaatgggatccatataaacagggatttggaaatgttgcaaccaacacagatgggaagaattactgtggccta

SEQ ID NO: 6868 - DNA, 201 bp, Homo sapiens; identical to SEQ ID NO: 6578

SEQ ID NO: 6869 - DNA, 201 bp, Homo sapiens
caaacttaaaaccatgaaacatctattattgctactattgtgtgtttttctagttaagtcccaaggtgtcaacgacaatgaggagggtttcttcagtgccygtggtcatcgaccccttgacaagaagagagaagaggctcccacccctgatgctggaggctgtcttcacgctgacccagacctgggggtgttgtgtcctac

SEQ ID NO: 6870 - DNA, 201 bp, Homo sapiens; identical to SEQ ID NO: 6580

SEQ ID NO: 6871 - DNA, 201 bp, Homo sapiens
acttaaaaccatgaaacatctattattgctactattgtgtgtttttctagttaagtcccaaggtgtcaacgacaatgaggagggtttcttcagtgcccgtkgtcatcgaccccttgacaagaagagagaagaggctcccacccctgatgctggaggctgtcttcacgctgacccagacctgggggtgttgtgtcctacagg

SEQ ID NO: 6872 - DNA, 201 bp, Homo sapiens; identical to SEQ ID NO: 6581

SEQ ID NO: 6873 - DNA, 201 bp, Homo sapiens; identical to SEQ ID NO: 6583

SEQ ID NO: 6874 - DNA, 201 bp, Homo sapiens; identical to SEQ ID NO: 6584

SEQ ID NO: 6875 - DNA, 201 bp, Homo sapiens; identical to SEQ ID NO: 6585

SEQ ID NO: 6876 - DNA, 201 bp, Homo sapiens; identical to SEQ ID NO: 6587

SEQ ID NO: 6877 - DNA, 201 bp, Homo sapiens; identical to SEQ ID NO: 6586

SEQ ID NO: 6878 - DNA, 201 bp, Homo sapiens; identical to SEQ ID NO: 6588

SEQ ID NO: 6879 - DNA, 201 bp, Homo sapiens; identical to SEQ ID NO: 6589

SEQ ID NO: 6880 - DNA, 201 bp, Homo sapiens; identical to SEQ ID NO: 6590

SEQ ID NO: 6881 - DNA, 201 bp, Homo sapiens; identical to SEQ ID NO: 6591

SEQ ID NO: 6882 - DNA, 113 bp, Homo sapiens; identical to SEQ ID NO: 6593

SEQ ID NO: 6883 - DNA, 201 bp, Homo sapiens; identical to SEQ ID NO: 6592

SEQ ID NO: 6884 - DNA, 201 bp, Homo sapiens; identical to SEQ ID NO: 6594

SEQ ID NO: 6885 - DNA, 201 bp, Homo sapiens; identical to SEQ ID NO: 6595

SEQ ID NO: 6886 - DNA, 201 bp, Homo sapiens
caatgaggagggtttcttcagtgcccgtggtcatcgaccccttgacaagaagagagaagaggctcccacccctgatgctggaggctgtcttcacgctgacycagacctgggggtgttgtgtcctacaggatgtcagttgcaagaggctttgctacaacaggaaaggccaatcagaaatagtgttgatgagttaaataacaa

SEQ ID NO: 6887 - DNA, 162 bp, Homo sapiens; identical to SEQ ID NO: 6597

SEQ ID NO: 6888 - DNA, 201 bp, Homo sapiens; identical to SEQ ID NO: 6596

SEQ ID NO: 6889 - DNA, 201 bp, Homo sapiens
tatgatgattgcttccacccacacgactgcaacatacaggtgccttggggaaatgtggagaacattcaatcttgccgtcactattcatcaatgaagattarcactgagatccagagaggctggatgacttgctcaagttcaccagcatggtagtggcaaagagaggtccagagtcctggcccttgatgcccagctcagtgc

SEQ ID NO: 6890 - DNA, 201 bp, Homo sapiens
agagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactgtcagttcatcctgcatgg

SEQ ID NO: 6891 - DNA, 201 bp, Homo sapiens
tctggacctcagtttccctctgtatacaaggatcagattcttgctgtgacccaagaactcctgaaatcatatagaaaggctggggtgggccctgtcattcrtggttgatttcaatacactcaagtgccattcatcctttaagaaaaacatctggatatcaaggtggaaatggcccatttaatgattgattatatcattttg

SEQ ID NO: 6892 - DNA, 171 bp, Homo sapiens
gcccatttaatgattgattatatcattttgtggatatagttataatctgatgggcctggctgggagtggaagaagggaagccttttgcaaatagtagagtrtcagttgcaggtgccaatgactaactttttgaattctatgttggcattaacaataaagcattttgcaaac

SEQ ID NO: 6893 - DNA, 201 bp, Homo sapiens
acatcctcttccttggcaaagtgaaccgcccctgaggtggggcttctcctgaaatctacaggcctcagggtgggagatgaagggggctaagctatggcccwtctgtatgctggtagctagtgatttacacaggtttagttgactaatgaggcattacaaataatattactctatgatgattgcttccacccacacgactgc

SEQ ID NO: 6894 - DNA, 201 bp, Homo sapiens
ggcccatctgtatgctggtagctagtgatttacacaggtttagttgactaatgaggcattacaaataatattactctatgatgattgcttccacccacacractgcaacatacaggtgccttggggaaatgtggagaacattcaatcttgccgtcactattcatcaatgaagattaacactgagatccagagaggctggat

SEQ ID NO: 6895 - DNA, 201 bp, Homo sapiens
ggggctgggtccagcacaaagatgcagatcctggagggcctgggcctcaacctccagaaaagctcagagaaggagctgcacagaggctttcagcagctccytcaggaactcaaccagcccagagatggcttccagctgagcctcggcaatgcccttttcaccgacctggtggtagacctgcaggacaccttcgtaagtgcc

SEQ ID NO: 6896 - DNA, 201 bp, Homo sapiens
tcagtgccacaaagctcaataggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaatgtgctgtgtgacattgggacaacactttccc

SEQ ID NO: 6897 - DNA, 201 bp, Homo sapiens
gctggtcccacacttatcagcagcaacaactgtcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaat

SEQ ID NO: 6898 - DNA, 201 bp, Homo sapiens
aaatctacaggcctcagggtgggagatgaagggggctaagctatggcccatctgtatgctggtagctagtgatttacacaggtttagttgactaatgaggyattacaaataatattactctatgatgattgcttccacccacacgactgcaacatacaggtgccttggggaaatgtggagaacattcaatcttgccgtcac

SEQ ID NO: 6899 - DNA, 201 bp, Homo sapiens
cccagccagagcatcttcttctcccctgtgagcatctccatgagcctggccatgctctccctgggggctgggtccagcacaaagatgcagatcctggaggkcctgggcctcaacctccagaaaagctcagagaaggagctgcacagaggctttcagcagctccttcaggaactcaaccagcccagagatggcttccagctg

SEQ ID NO: 6900 - DNA, 201 bp, Homo sapiens
gcttctcagccctcagggggcctcccttcaccgccaccacccccgggagatgaagaagagagtcgaggacctccatgtaggtgccacggtggcccccagcrgcagaagggactttacctttgacctctacagggccttggcttccgctgcccccagccagagcatcttcttctcccctgtgagcatctccatgagcctggc

SEQ ID NO: 6901 - DNA, 201 bp, Homo sapiens
atatccaggtgtctgagatggtgcacaaagctgtggtggaggtggacgagtcgggaaccagagcagcggcagccacggggacaatattcactttcaggtcrgcccgcctgaactctcagaggctagtgttcaacaggccctttctgatgttcattgtggataacaacatcctcttccttggcaaagtgaaccgcccctgag

SEQ ID NO: 6902 - DNA, 151 bp, Homo sapiens
tatcattttgtggatatagttataatctgatgggcctggctgggagtggaagaagggaagccttttgcaaatagtagagtatcagttgcaggtgccaatgrctaactttttgaattctatgttggcattaacaataaagcattttgcaaac

SEQ ID NO: 6903 - DNA, 201 bp, Homo sapiens
aaagatgcagatcctggagggcctgggcctcaacctccagaaaagctcagagaaggagctgcacagaggctttcagcagctccttcaggaactcaaccagsccagagatggcttccagctgagcctcggcaatgcccttttcaccgacctggtggtagacctgcaggacaccttcgtaagtgccatgaagacgctgtacct

SEQ ID NO: 6904 - DNA, 201 bp, Homo sapiens
aatgcggtcgtgatcatggtgaattacatcttctttaaagctaagtgggagacaagcttcaaccacaaaggcacccaagagcaagacttctacgtgacctyggagactgtggtgcgggtacccatgatgagccgcgaggatcagtatcactacctcctggaccggaacctctcctgcagggtggtgggggtcccctaccaa

SEQ ID NO: 6905 - DNA, 201 bp, Homo sapiens
ttaccttcccaaattctccattgagggctcctatcagctggagaaagtcctccccagtctggggatcagtaacgtcttcacctcccatgctgatctgtccsgcatcagcaaccactcaaatatccaggtgtctgagatggtgcacaaagctgtggtggaggtggacgagtcgggaaccagagcagcggcagccacggggac

SEQ ID NO: 6906 - DNA, 201 bp, Homo sapiens
gattgtggacttgcttaagaacctcgatagcaatgcggtcgtgatcatggtgaattacatcttctttaaagctaagtgggagacaagcttcaaccacaaasgcacccaagagcaagacttctacgtgacctcggagactgtggtgcgggtacccatgatgagccgcgaggatcagtatcactacctcctggaccggaacct

SEQ ID NO: 6907 - DNA, 201 bp, Homo sapiens
caccacccccgggagatgaagaagagagtcgaggacctccatgtaggtgccacggtggcccccagcagcagaagggactttacctttgacctctacagggycttggcttccgctgcccccagccagagcatcttcttctcccctgtgagcatctccatgagcctggccatgctctccctgggggctgggtccagcacaaag

SEQ ID NO: 6908 - DNA, 201 bp, Homo sapiens
tatccaaggcagcagaggtgagtgggtcccccgagctctgtgaccttatgctccacactaactctggcagagcctccgtttcctcatagaacaaagaacakccaccatgcagctcttcctcctcttgtgcctggtgcttctcagccctcagggggcctcccttcaccgccaccacccccgggagatgaagaagagagtcga

SEQ ID NO: 6909 - DNA, 201 bp, Homo sapiens
catctccatgagcctggccatgctctccctgggggctgggtccagcacaaagatgcagatcctggagggcctgggcctcaacctccagaaaagctcagagraggagctgcacagaggctttcagcagctccttcaggaactcaaccagcccagagatggcttccagctgagcctcggcaatgcccttttcaccgacctggt

SEQ ID NO: 6910 - DNA, 201 bp, Homo sapiens
aatattactctatgatgattgcttccacccacacgactgcaacatacaggtgccttggggaaatgtggagaacattcaatcttgccgtcactattcatcartgaagattaacactgagatccagagaggctggatgacttgctcaagttcaccagcatggtagtggcaaagagaggtccagagtcctggcccttgatgccc

SEQ ID NO: 6911 - DNA, 141 bp, Homo sapiens
ctttctgagcccgagggactgccacctccactgtgtgcacrctcagctacgggacacatttcaggtatccaaggcagcagaggtgagtgggtcccccgagctctgtgaccttatgctccacactaactctggcagagcctc

SEQ ID NO: 6912 - DNA, 201 bp, Homo sapiens
acgtgacctcggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggc

SEQ ID NO: 6913 - DNA, 201 bp, Homo sapiens
cctcccttcaccgccaccacccccgggagatgaagaagagagtcgaggacctccatgtaggtgccacggtggcccccagcagcagaagggactttaccttygacctctacagggccttggcttccgctgcccccagccagagcatcttcttctcccctgtgagcatctccatgagcctggccatgctctccctgggggctg

SEQ ID NO: 6914 - DNA, 201 bp, Homo sapiens
gtcgaggacctccatgtaggtgccacggtggcccccagcagcagaagggactttacctttgacctctacagggccttggcttccgctgcccccagccagarcatcttcttctcccctgtgagcatctccatgagcctggccatgctctccctgggggctgggtccagcacaaagatgcagatcctggagggcctgggcctc

SEQ ID NO: 6915 - DNA, 201 bp, Homo sapiens
agctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctcgata

SEQ ID NO: 6916 - DNA, 201 bp, Homo sapiens
tcgaggacctccatgtaggtgccacggtggcccccagcagcagaagggactttacctttgacctctacagggccttggcttccgctgcccccagccagagyatcttcttctcccctgtgagcatctccatgagcctggccatgctctccctgggggctgggtccagcacaaagatgcagatcctggagggcctgggcctca

SEQ ID NO: 6917 - DNA, 201 bp, Homo sapiens
ccctttctgatgttcattgtggataacaacatcctcttccttggcaaagtgaaccgcccctgaggtggggcttctcctgaaatctacaggcctcagggtgrgagatgaagggggctaagctatggcccatctgtatgctggtagctagtgatttacacaggtttagttgactaatgaggcattacaaataatattactcta

SEQ ID NO: 6918 - DNA, 201 bp, Homo sapiens
tccctaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaagctaagtgggagacaagcttcaaccacaaaggcacccaagagcaagacttctacg

SEQ ID NO: 6919 - DNA, 201 bp, Homo sapiens
tcagcaaccactcaaatatccaggtgtctgagatggtgcacaaagctgtggtggaggtggacgagtcgggaaccagagcagcggcagccacggggacaatmttcactttcaggtcggcccgcctgaactctcagaggctagtgttcaacaggccctttctgatgttcattgtggataacaacatcctcttccttggcaaag

SEQ ID NO: 6920 - DNA, 201 bp, Homo sapiens
acattgggacaacactttccctctctggacctcagtttccctctgtatacaaggatcagattcttgctgtgacccaagaactcctgaaatcatatagaaargctggggtgggccctgtcattcgtggttgatttcaatacactcaagtgccattcatcctttaagaaaaacatctggatatcaaggtggaaatggcccatt

SEQ ID NO: 6921 - DNA, 201 bp, Homo sapiens
tgtggataacaacatcctcttccttggcaaagtgaaccgcccctgaggtggggcttctcctgaaatctacaggcctcagggtgggagatgaagggggctawgctatggcccatctgtatgctggtagctagtgatttacacaggtttagttgactaatgaggcattacaaataatattactctatgatgattgcttccacc

SEQ ID NO: 6922 - DNA, 201 bp, Homo sapiens; identical to SEQ ID NO: 6889

SEQ ID NO: 6923 - DNA, 201 bp, Homo sapiens; identical to SEQ ID NO: 6890

SEQ ID NO: 6924 - DNA, 201 bp, Homo sapiens; identical to SEQ ID NO: 6891

SEQ ID NO: 6925 - DNA, 171 bp, Homo sapiens; identical to SEQ ID NO: 6892

SEQ ID NO: 6926 - DNA, 201 bp, Homo sapiens; identical to SEQ ID NO: 6893

SEQ ID NO: 6927 - DNA, 201 bp, Homo sapiens; identical to SEQ ID NO: 6894

SEQ ID NO: 6928 - DNA, 201 bp, Homo sapiens; identical to SEQ ID NO: 6895

SEQ ID NO: 6929 - DNA, 201 bp, Homo sapiens; identical to SEQ ID NO: 6896

SEQ ID NO: 6930 - DNA, 201 bp, Homo sapiens; identical to SEQ ID NO: 6897

SEQ ID NO: 6931 - DNA, 201 bp, Homo sapiens; identical to SEQ ID NO: 6898

SEQ ID NO: 6932 - DNA, 201 bp, Homo sapiens; identical to SEQ ID NO: 6899

SEQ ID NO: 6933 - DNA, 201 bp, Homo sapiens; identical to SEQ ID NO: 6900

SEQ ID NO: 6934 - DNA, 201 bp, Homo sapiens; identical to SEQ ID NO: 6901

SEQ ID NO: 6935 - DNA, 151 bp, Homo sapiens; identical to SEQ ID NO: 6902

SEQ ID NO: 6936 - DNA, 201 bp, Homo sapiens; identical to SEQ ID NO: 6903

SEQ ID NO: 6937 - DNA, 201 bp, Homo sapiens; identical to SEQ ID NO: 6904

SEQ ID NO: 6938 - DNA, 201 bp, Homo sapiens; identical to SEQ ID NO: 6905

SEQ ID NO: 6939 - DNA, 201 bp, Homo sapiens; identical to SEQ ID NO: 6906

SEQ ID NO: 6940 - DNA, 201 bp, Homo sapiens; identical to SEQ ID NO: 6907

SEQ ID NO: 6941 - DNA, 170 bp, Homo sapiens
ctttctgagcccgagggactgccacctccactgtgtgcacactcagctacgggacacaaacaaagaacakccaccatgcagctcttcctcctcttgtgcctggtgcttctcagccctcagggggcctcccttcaccgccaccacccccgggagatgaagaagagagtcga

SEQ ID NO: 6942 - DNA, 201 bp, Homo sapiens; identical to SEQ ID NO: 6909

SEQ ID NO: 6943 - DNA, 201 bp, Homo sapiens; identical to SEQ ID NO: 6910

SEQ ID NO: 6944 - DNA, 141 bp, Homo sapiens
ctttctgagcccgagggactgccacctccactgtgtgcacrctcagctacgggacacaaacaaagaacagccaccatgcagctcttcctcctcttgtgcctggtgcttctcagccctcagggggcctcccttcaccgccac

SEQ ID NO: 6945 - DNA, 201 bp, Homo sapiens; identical to SEQ ID NO: 6912

SEQ ID NO: 6946 - DNA, 201 bp, Homo sapiens; identical to SEQ ID NO: 6913

SEQ ID NO: 6947 - DNA, 201 bp, Homo sapiens; identical to SEQ ID NO: 6914

SEQ ID NO: 6948 - DNA, 201 bp, Homo sapiens; identical to SEQ ID NO: 6915

SEQ ID NO: 6949 - DNA, 201 bp, Homo sapiens; identical to SEQ ID NO: 6916

SEQ ID NO: 6950 - DNA, 201 bp, Homo sapiens; identical to SEQ ID NO: 6917

SEQ ID NO: 6951 - DNA, 201 bp, Homo sapiens; identical to SEQ ID NO: 6918

SEQ ID NO: 6952 - DNA, 201 bp, Homo sapiens; identical to SEQ ID NO: 6919

SEQ ID NO: 6953 - DNA, 201 bp, Homo sapiens; identical to SEQ ID NO: 6920

SEQ ID NO: 6954 - DNA, 201 bp, Homo sapiens; identical to SEQ ID NO: 6921

SEQ ID NO: 6955 - DNA, 201 bp, Homo sapiens; identical to SEQ ID NO: 6889

SEQ ID NO: 6956 - DNA, 201 bp, Homo sapiens; identical to SEQ ID NO: 6890

SEQ ID NO: 6957 - DNA, 201 bp, Homo sapiens; identical to SEQ ID NO: 6891

SEQ ID NO: 6958 - DNA, 171 bp, Homo sapiens; identical to SEQ ID NO: 6892

SEQ ID NO: 6959 - DNA, 201 bp, Homo sapiens; identical to SEQ ID NO: 6893

SEQ ID NO: 6960 - DNA, 201 bp, Homo sapiens; identical to SEQ ID NO: 6894

SEQ ID NO: 6961 - DNA, 201 bp, Homo sapiens; identical to SEQ ID NO: 6895

SEQ ID NO: 6962 - DNA, 201 bp, Homo sapiens; identical to SEQ ID NO: 6896

SEQ ID NO: 6963 - DNA, 201 bp, Homo sapiens; identical to SEQ ID NO: 6897

SEQ ID NO: 6964 - DNA, 201 bp, Homo sapiens; identical to SEQ ID NO: 6898

SEQ ID NO: 6965 - DNA, 201 bp, Homo sapiens; identical to SEQ ID NO: 6899

SEQ ID NO: 6966 - DNA, 201 bp, Homo sapiens; identical to SEQ ID NO: 6900

SEQ ID NO: 6967 - DNA, 201 bp, Homo sapiens; identical to SEQ ID NO: 6901

SEQ ID NO: 6968 - DNA, 151 bp, Homo sapiens; identical to SEQ ID NO: 6902

SEQ ID NO: 6969 - DNA, 201 bp, Homo sapiens; identical to SEQ ID NO: 6903

SEQ ID NO: 6970 - DNA, 201 bp, Homo sapiens; identical to SEQ ID NO: 6904

SEQ ID NO: 6971 - DNA, 201 bp, Homo sapiens; identical to SEQ ID NO: 6905

SEQ ID NO: 6972 - DNA, 201 bp, Homo sapiens; identical to SEQ ID NO: 6906

SEQ ID NO: 6973 - DNA, 201 bp, Homo sapiens; identical to SEQ ID NO: 6907

SEQ ID NO: 6974 - DNA, 194 bp, Homo sapiens
ctttctgagcccgagggactgccacctccactgtgtgcacactcagctacgggacacatttcaggtatccaaggcagcagagaacaaagaacakccaccatgcagctcttcctcctcttgtgcctggtgcttctcagccctcagggggcctcccttcaccgccaccacccccgggagatgaagaagagagtcga

SEQ ID NO: 6975 - DNA, 201 bp, Homo sapiens; identical to SEQ ID NO: 6909

SEQ ID NO: 6976 - DNA, 201 bp, Homo sapiens; identical to SEQ ID NO: 6910

SEQ ID NO: 6977 - DNA, 141 bp, Homo sapiens
ctttctgagcccgagggactgccacctccactgtgtgcacrctcagctacgggacacatttcaggtatccaaggcagcagagaacaaagaacagccaccatgcagctcttcctcctcttgtgcctggtgcttctcagccct

SEQ ID NO: 6978 - DNA, 201 bp, Homo sapiens; identical to SEQ ID NO: 6912

SEQ ID NO: 6979 - DNA, 201 bp, Homo sapiens; identical to SEQ ID NO: 6913

SEQ ID NO: 6980 - DNA, 201 bp, Homo sapiens; identical to SEQ ID NO: 6914

SEQ ID NO: 6981 - DNA, 201 bp, Homo sapiens; identical to SEQ ID NO: 6915

SEQ ID NO: 6982 - DNA, 201 bp, Homo sapiens; identical to SEQ ID NO: 6916

SEQ ID NO: 6983 - DNA, 201 bp, Homo sapiens; identical to SEQ ID NO: 6917

SEQ ID NO: 6984 - DNA, 201 bp, Homo sapiens; identical to SEQ ID NO: 6918

SEQ ID NO: 6985 - DNA, 201 bp, Homo sapiens; identical to SEQ ID NO: 6919

SEQ ID NO: 6986 - DNA, 201 bp, Homo sapiens; identical to SEQ ID NO: 6920

SEQ ID NO: 6987 - DNA, 201 bp, Homo sapiens; identical to SEQ ID NO: 6921

SEQ ID NO: 6988 - DNA, 201 bp, Homo sapiens; identical to SEQ ID NO: 6889

SEQ ID NO: 6989 - DNA, 201 bp, Homo sapiens; identical to SEQ ID NO: 6890

SEQ ID NO: 6990 - DNA, 201 bp, Homo sapiens; identical to SEQ ID NO: 6891

SEQ ID NO: 6991 - DNA, 171 bp, Homo sapiens; identical to SEQ ID NO: 6892

SEQ ID NO: 6992 - DNA, 201 bp, Homo sapiens; identical to SEQ ID NO: 6893

SEQ ID NO: 6993 - DNA, 201 bp, Homo sapiens; identical to SEQ ID NO: 6894

SEQ ID NO: 6994 - DNA, 201 bp, Homo sapiens; identical to SEQ ID NO: 6895

SEQ ID NO: 6995 - DNA, 201 bp, Homo sapiens; identical to SEQ ID NO: 6896

SEQ ID NO: 6996 - DNA, 201 bp, Homo sapiens; identical to SEQ ID NO: 6897

SEQ ID NO: 6997 - DNA, 201 bp, Homo sapiens; identical to SEQ ID NO: 6898

SEQ ID NO: 6998 - DNA, 201 bp, Homo sapiens; identical to SEQ ID NO: 6899

SEQ ID NO: 6999 - DNA, 201 bp, Homo sapiens; identical to SEQ ID NO: 6900

SEQ ID NO: 7000 - DNA, 201 bp, Homo sapiens; identical to SEQ ID NO: 6901

SEQ ID NO: 7001 - DNA, 151 bp, Homo sapiens; identical to SEQ ID NO: 6902

SEQ ID NO: 7002 - DNA, 201 bp, Homo sapiens; identical to SEQ ID NO: 6903

SEQ ID NO: 7003 - DNA, 201 bp, Homo sapiens; identical to SEQ ID NO: 6904

SEQ ID NO: 7004 - DNA, 201 bp, Homo sapiens; identical to SEQ ID NO: 6905

SEQ ID NO: 7005 - DNA, 201 bp, Homo sapiens; identical to SEQ ID NO: 6906

SEQ ID NO: 7006 - DNA, 201 bp, Homo sapiens; identical to SEQ ID NO: 6907

SEQ ID NO: 7007 - DNA, 201 bp, Homo sapiens
aggatggactctagagttttggggtttggggtctgcaaagctctgaaggagtctcatctctgcagtttcaggtatccaaggcagcagagaacaaagaacakccaccatgcagctcttcctcctcttgtgcctggtgcttctcagccctcagggggcctcccttcaccgccaccacccccgggagatgaagaagagagtcga

SEQ ID NO: 7008 - DNA, 201 bp, Homo sapiens; identical to SEQ ID NO: 6909

SEQ ID NO: 7009 - DNA, 201 bp, Homo sapiens; identical to SEQ ID NO: 6910

SEQ ID NO: 7010 - DNA, 201 bp, Homo sapiens; identical to SEQ ID NO: 6912

SEQ ID NO: 7011 - DNA, 201 bp, Homo sapiens; identical to SEQ ID NO: 6913

SEQ ID NO: 7012 - DNA, 201 bp, Homo sapiens; identical to SEQ ID NO: 6914

SEQ ID NO: 7013 - DNA, 116 bp, Homo sapiens
gacacagtaagtaccratgccgcaaagggaggtccccagggcttgagggcatgtgaggcgaggagaggatggactctagagttttggggtttggggtctgcaaagctctgaaggag

SEQ ID NO: 7014 - DNA, 201 bp, Homo sapiens; identical to SEQ ID NO: 6915

SEQ ID NO: 7015 - DNA, 201 bp, Homo sapiens; identical to SEQ ID NO: 6916

SEQ ID NO: 7016 - DNA, 201 bp, Homo sapiens; identical to SEQ ID NO: 6917

SEQ ID NO: 7017 - DNA, 126 bp, Homo sapiens
gacacagtaagtaccgatgccgcaamgggaggtccccagggcttgagggcatgtgaggcgaggagaggatggactctagagttttggggtttggggtctgcaaagctctgaaggagtctcatctct

SEQ ID NO: 7018 - DNA, 201 bp, Homo sapiens; identical to SEQ ID NO: 6918

SEQ ID NO: 7019 - DNA, 201 bp, Homo sapiens; identical to SEQ ID NO: 6919

SEQ ID NO: 7020 - DNA, 201 bp, Homo sapiens; identical to SEQ ID NO: 6920

SEQ ID NO: 7021 - DNA, 201 bp, Homo sapiens; identical to SEQ ID NO: 6921

SEQ ID NO: 7022 - DNA, 201 bp, Homo sapiens; identical to SEQ ID NO: 6889

SEQ ID NO: 7023 - DNA, 201 bp, Homo sapiens; identical to SEQ ID NO: 6890

SEQ ID NO: 7024 - DNA, 201 bp, Homo sapiens; identical to SEQ ID NO: 6891

SEQ ID NO: 7025 - DNA, 171 bp, Homo sapiens; identical to SEQ ID NO: 6892

SEQ ID NO: 7026 - DNA, 201 bp, Homo sapiens; identical to SEQ ID NO: 6893

SEQ ID NO: 7027 - DNA, 201 bp, Homo sapiens; identical to SEQ ID NO: 6895

SEQ ID NO: 7028 - DNA, 201 bp, Homo sapiens; identical to SEQ ID NO: 6894

SEQ ID NO: 7029 - DNA, 201 bp, Homo sapiens; identical to SEQ ID NO: 6896

SEQ ID NO: 7030 - DNA, 201 bp, Homo sapiens; identical to SEQ ID NO: 6898

SEQ ID NO: 7031 - DNA, 201 bp, Homo sapiens; identical to SEQ ID NO: 6897

SEQ ID NO: 7032 - DNA, 201 bp, Homo sapiens; identical to SEQ ID NO: 6899

SEQ ID NO: 7033 - DNA, 201 bp, Homo sapiens; identical to SEQ ID NO: 6900

SEQ ID NO: 7034 - DNA, 201 bp, Homo sapiens; identical to SEQ ID NO: 6901

SEQ ID NO: 7035 - DNA, 201 bp, Homo sapiens; identical to SEQ ID NO: 6903

SEQ ID NO: 7036 - DNA, 151 bp, Homo sapiens; identical to SEQ ID NO: 6902

SEQ ID NO: 7037 - DNA, 201 bp, Homo sapiens; identical to SEQ ID NO: 6904

SEQ ID NO: 7038 - DNA, 201 bp, Homo sapiens; identical to SEQ ID NO: 6905

SEQ ID NO: 7039 - DNA, 201 bp, Homo sapiens; identical to SEQ ID NO: 6906

SEQ ID NO: 7040 - DNA, 201 bp, Homo sapiens; identical to SEQ ID NO: 6907

SEQ ID NO: 7041 - DNA, 201 bp, Homo sapiens; identical to SEQ ID NO: 6909

SEQ ID NO: 7042 - DNA, 148 bp, Homo sapiens
atggggacaaaatgtcggctggataggaggtgctcaaacaaagaacakccaccatgcagctcttcctcctcttgtgcctggtgcttctcagccctcagggggcctcccttcaccgccaccacccccgggagatgaagaagagagtcga

SEQ ID NO: 7043 - DNA, 201 bp, Homo sapiens; identical to SEQ ID NO: 6914

SEQ ID NO: 7044 - DNA, 201 bp, Homo sapiens; identical to SEQ ID NO: 6913

SEQ ID NO: 7045 - DNA, 201 bp, Homo sapiens; identical to SEQ ID NO: 6912

SEQ ID NO: 7046 - DNA, 201 bp, Homo sapiens; identical to SEQ ID NO: 6910

SEQ ID NO: 7047 - DNA, 201 bp, Homo sapiens; identical to SEQ ID NO: 6916

SEQ ID NO: 7048 - DNA, 201 bp, Homo sapiens; identical to SEQ ID NO: 6915

SEQ ID NO: 7049 - DNA, 201 bp, Homo sapiens; identical to SEQ ID NO: 6918

SEQ ID NO: 7050 - DNA, 201 bp, Homo sapiens; identical to SEQ ID NO: 6917

SEQ ID NO: 7051 - DNA, 201 bp, Homo sapiens; identical to SEQ ID NO: 6919

SEQ ID NO: 7052 - DNA, 201 bp, Homo sapiens; identical to SEQ ID NO: 6921

SEQ ID NO: 7053 - DNA, 201 bp, Homo sapiens; identical to SEQ ID NO: 6920

SEQ ID NO: 7054 - DNA, 201 bp, Homo sapiens
ctccctccgtctctaccaggaatggccttgtcctatggaaggcactgccccatcccaaactaatctaggaatcactgtctaaccactcactgtcatgaatrtgtacttaaaggatgaggttgagtcataccaaatagtgatttcgatagttcaaaatggtgaaattagcaattctacatgattcagtctaatcaatggata

SEQ ID NO: 7055 - DNA, 201 bp, Homo sapiens
gctgtgctgaccatcgacgagaaagggactgaagctgctggggccatgtttttagaggccatacccatgtctatcccccccgaggtcaagttcaacaaacyctttgtcttcttaatgattgaacaaaataccaagtctcccctcttcatgggaaaagtggtgaatcccacccaaaaataactgcctctcgctcctcaaccc

SEQ ID NO: 7056 - DNA, 201 bp, Homo sapiens
ggctgtgctgaccatcgacgagaaagggactgaagctgctggggccatgtttttagaggccatacccatgtctatcccccccgaggtcaagttcaacaaaycctttgtcttcttaatgattgaacaaaataccaagtctcccctcttcatgggaaaagtggtgaatcccacccaaaaataactgcctctcgctcctcaacc

SEQ ID NO: 7057 - DNA, 201 bp, Homo sapiens
ctctgagtcccgactggggccacatgcagcctgacttctttgtgcctgttgctgtccctgcagtcttcagagggccaccgcagctccagtgccacggcagraggctgttcctgaatagcccctgtggtaagggccaggagagtccttccatcctccaaggccctgctaaaggacacagcagccaggaagtcccctgggccc

SEQ ID NO: 7058 - DNA, 201 bp, Homo sapiens
aggtcaagttcaacaaaccctttgtcttcttaatgattgaacaaaataccaagtctcccctcttcatgggaaaagtggtgaatcccacccaaaaataactkcctctcgctcctcaacccctcccctccatccctggccccctccctggatgacattaaagaagggttgagctggtccctgcctgcatgtgactgtaaatcc

SEQ ID NO: 7059 - DNA, 201 bp, Homo sapiens
agatgctgcccagaagacagatacatcccaccatgatcaggatcacccaaccttcaacaagatcacccccaacctggctgagttcgccttcagcctatacygccagctggcacaccagtccaacagcaccaatatcttcttctccccagtgagcatcgctacagcctttgcaatgctctccctggggaccaaggctgacac

SEQ ID NO: 7060 - DNA, 201 bp, Homo sapiens
gcccagaagacagatacatcccaccatgatcaggatcacccaaccttcaacaagatcacccccaacctggctgagttcgccttcagcctataccgccagcyggcacaccagtccaacagcaccaatatcttcttctccccagtgagcatcgctacagcctttgcaatgctctccctggggaccaaggctgacactcacgat

SEQ ID NO: 7061 - DNA, 201 bp, Homo sapiens
cacccaaccttcaacaagatcacccccaacctggctgagttcgccttcagcctataccgccagctggcacaccagtccaacagcaccaatatcttcttctycccagtgagcatcgctacagcctttgcaatgctctccctggggaccaaggctgacactcacgatgaaatcctggagggcctgaatttcaacctcacggag

SEQ ID NO: 7062 - DNA, 201 bp, Homo sapiens
ctccctttgcctgctgaggctgtatgtgggctccaggtaacagtgctgtcttcgggccccctgaactgtgttcatggagcatctggctgggtaggcacatrctgggcttgaatccaggggggactgaatcctcagcttacggacctgggcccatctgtttctggagggctccagtcttccttgtcctgtcttggagtcccc

SEQ ID NO: 7063 - DNA, 201 bp, Homo sapiens
aggcacatgctgggcttgaatccaggggggactgaatcctcagcttacggacctgggcccatctgtttctggagggctccagtcttccttgtcctgtcttkgagtccccaagaaggaatcacaggggaggaaccagataccagccatgaccccaggctccaccaagcatcttcatgtccccctgctcatcccccactcccc

SEQ ID NO: 7064 - DNA, 201 bp, Homo sapiens
gtgaatcccacccaaaaataactgcctctcgctcctcaacccctcccctccatccctggccccctccctggatgacattaaagaagggttgagctggtccytgcctgcatgtgactgtaaatccctcccatgttttctctgagtctccctttgcctgctgaggctgtatgtgggctccaggtaacagtgctgtcttcgggc

SEQ ID NO: 7065 - DNA, 201 bp, Homo sapiens
ggcaatgagcaaggctccttcctgtccaagctccccgcccctccccagcctactgcctccacccgaagtctacttcctgggtgggcaggaactgggcactstgcccagggcatgcactgcctccacgcagcaaccctcagagtcctgagctgaaccaagaaggaggagggggtcgggcctccgaggaaggcctagccgctg

SEQ ID NO: 7066 - DNA, 201 bp, Homo sapiens
acagcctttgcaatgctctccctggggaccaaggctgacactcacgatgaaatcctggagggcctgaatttcaacctcacggagattccggaggctcagawccatgaaggcttccaggaactcctccgtaccctcaaccagccagacagccagctccagctgaccaccggcaatggcctgttcctcagcgagggcctgaag

SEQ ID NO: 7067 - DNA, 201 bp, Homo sapiens
ttctccccagtgagcatcgctacagcctttgcaatgctctccctggggaccaaggctgacactcacgatgaaatcctggagggcctgaatttcaacctcayggagattccggaggctcagatccatgaaggcttccaggaactcctccgtaccctcaaccagccagacagccagctccagctgaccaccggcaatggcctg

SEQ ID NO: 7068 - DNA, 201 bp, Homo sapiens
aagggactgaagctgctggggccatgtttttagaggccatacccatgtctatcccccccgaggtcaagttcaacaaaccctttgtcttcttaatgattgamcaaaataccaagtctcccctcttcatgggaaaagtggtgaatcccacccaaaaataactgcctctcgctcctcaacccctcccctccatccctggccccc

SEQ ID NO: 7069 - DNA, 201 bp, Homo sapiens
gtttaggcatgtttaacatccagcactgtaagaagctgtccagctgggtgctgctgatgaaatacctgggcaatgccaccgccatcttcttcctgcctgaygaggggaaactacagcacctggaaaatgaactcacccacgatatcatcaccaagttcctggaaaatgaagacagaaggtctgccagcttacatttaccca

SEQ ID NO: 7070 - DNA, 201 bp, Homo sapiens
aactgggcatcactaaggtcttcagcaatggggctgacctctccggggtcacagaggaggcacccctgaagctctccaaggccgtgcataaggctgtgctkaccatcgacgagaaagggactgaagctgctggggccatgtttttagaggccatacccatgtctatcccccccgaggtcaagttcaacaaaccctttgtct

SEQ ID NO: 7071 - DNA, 201 bp, Homo sapiens
tggataagtttttggaggatgttaaaaagttgtaccactcagaagccttcactgtcaacttcggggacaccgaagaggccaagaaacagatcaacgattasgtggagaagggtactcaagggaaaattgtggatttggtcaaggagcttgacagagacacagtttttgctctggtgaattacatcttctttaaaggcaaat

SEQ ID NO: 7072 - DNA, 201 bp, Homo sapiens
cactgtgcccagggcatgcactgcctccacgcagcaaccctcagagtcctgagctgaaccaagaaggaggagggggtcgggcctccgaggaaggcctagcygctgctgctgccaggaattccaggttggaggggcggcaacctcctgccagccttcaggccactctcctgtgcctgccagaagagacagagcttgaggaga

SEQ ID NO: 7073 - DNA, 201 bp, Homo sapiens
ggctgacctctccggggtcacagaggaggcacccctgaagctctccaaggccgtgcataaggctgtgctgaccatcgacgagaaagggactgaagctgctkgggccatgtttttagaggccatacccatgtctatcccccccgaggtcaagttcaacaaaccctttgtcttcttaatgattgaacaaaataccaagtctcc

SEQ ID NO: 7074 - DNA, 201 bp, Homo sapiens
gctctccaaggccgtgcataaggctgtgctgaccatcgacgagaaagggactgaagctgctggggccatgtttttagaggccatacccatgtctatccccyccgaggtcaagttcaacaaaccctttgtcttcttaatgattgaacaaaataccaagtctcccctcttcatgggaaaagtggtgaatcccacccaaaaata

SEQ ID NO: 7075 - DNA, 201 bp, Homo sapiens
atgtctatcccccccgaggtcaagttcaacaaaccctttgtcttcttaatgattgaacaaaataccaagtctcccctcttcatgggaaaagtggtgaatcmcacccaaaaataactgcctctcgctcctcaacccctcccctccatccctggccccctccctggatgacattaaagaagggttgagctggtccctgcctgc

SEQ ID NO: 7076 - DNA, 201 bp, Homo sapiens
ctgccccatcccaaactaatctaggaatcactgtctaaccactcactgtcatgaatgtgtacttaaaggatgaggttgagtcataccaaatagtgatttcsatagttcaaaatggtgaaattagcaattctacatgattcagtctaatcaatggataccgactgtttcccacacaagtctcctgttctcttaagcttactc

SEQ ID NO: 7077 - DNA, 201 bp, Homo sapiens
cactgtaagaagctgtccagctgggtgctgctgatgaaatacctgggcaatgccaccgccatcttcttcctgcctgatgaggggaaactacagcacctggwaaatgaactcacccacgatatcatcaccaagttcctggaaaatgaagacagaaggtctgccagcttacatttacccaaactgtccattactggaacctat

SEQ ID NO: 7078 - DNA, 201 bp, Homo sapiens
gtctatcccccccgaggtcaagttcaacaaaccctttgtcttcttaatgattgaacaaaataccaagtctcccctcttcatgggaaaagtggtgaatcccmcccaaaaataactgcctctcgctcctcaacccctcccctccatccctggccccctccctggatgacattaaagaagggttgagctggtccctgcctgcat

SEQ ID NO: 7079 - DNA, 201 bp, Homo sapiens
caagttcaacaaaccctttgtcttcttaatgattgaacaaaataccaagtctcccctcttcatgggaaaagtggtgaatcccacccaaaaataactgcctytcgctcctcaacccctcccctccatccctggccccctccctggatgacattaaagaagggttgagctggtccctgcctgcatgtgactgtaaatccctcc

SEQ ID NO: 7080 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccagcagcctcccccgttgcccctctggatccactgcttaaatacggac

SEQ ID NO: 7081 - DNA, 201 bp, Homo sapiens
ccaaggccctgctaaaggacacagcagccaggaagtcccctgggcccctagctgaaggacagcctgctccctccgtctctaccaggaatggccttgtcctrtggaaggcactgccccatcccaaactaatctaggaatcactgtctaaccactcactgtcatgaatgtgtacttaaaggatgaggttgagtcataccaaat

SEQ ID NO: 7082 - DNA, 201 bp, Homo sapiens
cctgggtcaactgggcatcactaaggtcttcagcaatggggctgacctctccggggtcacagaggaggcacccctgaagctctccaaggccgtgcataagrctgtgctgaccatcgacgagaaagggactgaagctgctggggccatgtttttagaggccatacccatgtctatcccccccgaggtcaagttcaacaaacc

SEQ ID NO: 7083 - DNA, 201 bp, Homo sapiens
tttcaacctcacggagattccggaggctcagatccatgaaggcttccaggaactcctccgtaccctcaaccagccagacagccagctccagctgaccaccrgcaatggcctgttcctcagcgagggcctgaagctagtggataagtttttggaggatgttaaaaagttgtaccactcagaagccttcactgtcaacttcgg

SEQ ID NO: 7084 - DNA, 201 bp, Homo sapiens
gcacccctgaagctctccaaggccgtgcataaggctgtgctgaccatcgacgagaaagggactgaagctgctggggccatgtttttagaggccatacccakgtctatcccccccgaggtcaagttcaacaaaccctttgtcttcttaatgattgaacaaaataccaagtctcccctcttcatgggaaaagtggtgaatccc

SEQ ID NO: 7085 - DNA, 201 bp, Homo sapiens
cggcaatggcctgttcctcagcgagggcctgaagctagtggataagtttttggaggatgttaaaaagttgtaccactcagaagccttcactgtcaacttcrgggacaccgaagaggccaagaaacagatcaacgattacgtggagaagggtactcaagggaaaattgtggatttggtcaaggagcttgacagagacacagt

SEQ ID NO: 7086 - DNA, 201 bp, Homo sapiens
ccatcgacgagaaagggactgaagctgctggggccatgtttttagaggccatacccatgtctatcccccccgaggtcaagttcaacaaaccctttgtcttyttaatgattgaacaaaataccaagtctcccctcttcatgggaaaagtggtgaatcccacccaaaaataactgcctctcgctcctcaacccctcccctcca

SEQ ID NO: 7087 - DNA, 201 bp, Homo sapiens
ctttaaaggcaaatgggagagaccctttgaagtcaaggacaccgaggaagaggacttccacgtggaccaggcgaccaccgtgaaggtgcctatgatgaagygtttaggcatgtttaacatccagcactgtaagaagctgtccagctgggtgctgctgatgaaatacctgggcaatgccaccgccatcttcttcctgcctga

SEQ ID NO: 7088 - DNA, 201 bp, Homo sapiens
aggtcttcagcaatggggctgacctctccggggtcacagaggaggcacccctgaagctctccaaggccgtgcataaggctgtgctgaccatcgacgagaargggactgaagctgctggggccatgtttttagaggccatacccatgtctatcccccccgaggtcaagttcaacaaaccctttgtcttcttaatgattgaac

SEQ ID NO: 7089 - DNA, 201 bp, Homo sapiens
taggcctgctgatggctcaggaaggccattgcaaggactcctcagctatgggagaggaagcacatcacccattgacccccgcaacccctccctttcctccyctgagtcccgactggggccacatgcagcctgacttctttgtgcctgttgctgtccctgcagtcttcagagggccaccgcagctccagtgccacggcagga

SEQ ID NO: 7090 - DNA, 201 bp, Homo sapiens
tgggcatcactaaggtcttcagcaatggggctgacctctccggggtcacagaggaggcacccctgaagctctccaaggccgtgcataaggctgtgctgacsatcgacgagaaagggactgaagctgctggggccatgtttttagaggccatacccatgtctatcccccccgaggtcaagttcaacaaaccctttgtcttct

SEQ ID NO: 7091 - DNA, 201 bp, Homo sapiens
gccttcagcctataccgccagctggcacaccagtccaacagcaccaatatcttcttctccccagtgagcatcgctacagcctttgcaatgctctccctggrgaccaaggctgacactcacgatgaaatcctggagggcctgaatttcaacctcacggagattccggaggctcagatccatgaaggcttccaggaactcctc

SEQ ID NO: 7092 - DNA, 201 bp, Homo sapiens
agagcgtcctgggtcaactgggcatcactaaggtcttcagcaatggggctgacctctccggggtcacagaggaggcacccctgaagctctccaaggccgtscataaggctgtgctgaccatcgacgagaaagggactgaagctgctggggccatgtttttagaggccatacccatgtctatcccccccgaggtcaagttca

SEQ ID NO: 7093 - DNA, 201 bp, Homo sapiens
gaagaggagggtctctgctttgttttctctatctcctcctcagacttgaccaggcccagcaggccccagaagaccattaccctatatcccttctcctcccyagtcacatggccataggcctgctgatggctcaggaaggccattgcaaggactcctcagctatgggagaggaagcacatcacccattgacccccgcaaccc

SEQ ID NO: 7094 - DNA, 201 bp, Homo sapiens
tgaaggtgcctatgatgaagcgtttaggcatgtttaacatccagcactgtaagaagctgtccagctgggtgctgctgatgaaatacctgggcaatgccacygccatcttcttcctgcctgatgaggggaaactacagcacctggaaaatgaactcacccacgatatcatcaccaagttcctggaaaatgaagacagaaggt

SEQ ID NO: 7095 - DNA, 201 bp, Homo sapiens
gcatcttcatgtccccctgctcatcccccactcccccccacccagagttgctcatcctgccagggctggctgtgcccaccccaaggctgccctcctggggrccccagaactgcctgatcgtgccgtggcccagttttgtggcatctgcagcaacacaagagagaggacaatgtcctcctcttgacccgctgtcacctaacc

SEQ ID NO: 7096 - DNA, 201 bp, Homo sapiens
atccactgcttaaatacggacgaggacagggccctgtctcctcagcttcaggcaccaccactgacctgggacagtgaatcgacaatgccgtcttctgtctygtggggcatcctcctgctggcaggcctgtgctgcctggtccctgtctccctggctgaggatccccagggagatgctgcccagaagacagatacatcccac

SEQ ID NO: 7097 - DNA, 201 bp, Homo sapiens
acagtttttgctctggtgaattacatcttctttaaaggcaaatgggagagaccctttgaagtcaaggacaccgaggaagaggacttccacgtggaccaggygaccaccgtgaaggtgcctatgatgaagcgtttaggcatgtttaacatccagcactgtaagaagctgtccagctgggtgctgctgatgaaatacctgggc

SEQ ID NO: 7098 - DNA, 201 bp, Homo sapiens
cacggagattccggaggctcagatccatgaaggcttccaggaactcctccgtaccctcaaccagccagacagccagctccagctgaccaccggcaatggcytgttcctcagcgagggcctgaagctagtggataagtttttggaggatgttaaaaagttgtaccactcagaagccttcactgtcaacttcggggacaccga

SEQ ID NO: 7099 - DNA, 201 bp, Homo sapiens
ctcgtggggcatcctcctgctggcaggcctgtgctgcctggtccctgtctccctggctgaggatccccagggagatgctgcccagaagacagatacatccmaccatgatcaggatcacccaaccttcaacaagatcacccccaacctggctgagttcgccttcagcctataccgccagctggcacaccagtccaacagcac

SEQ ID NO: 7100 - DNA, 201 bp, Homo sapiens
aagtcaaggacaccgaggaagaggacttccacgtggaccaggcgaccaccgtgaaggtgcctatgatgaagcgtttaggcatgtttaacatccagcactgkaagaagctgtccagctgggtgctgctgatgaaatacctgggcaatgccaccgccatcttcttcctgcctgatgaggggaaactacagcacctggaaaatg

SEQ ID NO: 7101 - DNA, 201 bp, Homo sapiens
aggacaccgaggaagaggacttccacgtggaccaggcgaccaccgtgaaggtgcctatgatgaagcgtttaggcatgtttaacatccagcactgtaagaarctgtccagctgggtgctgctgatgaaatacctgggcaatgccaccgccatcttcttcctgcctgatgaggggaaactacagcacctggaaaatgaactca

SEQ ID NO: 7102 - DNA, 201 bp, Homo sapiens
tctggtgaattacatcttctttaaaggcaaatgggagagaccctttgaagtcaaggacaccgaggaagaggacttccacgtggaccaggcgaccaccgtgwaggtgcctatgatgaagcgtttaggcatgtttaacatccagcactgtaagaagctgtccagctgggtgctgctgatgaaatacctgggcaatgccaccgc

SEQ ID NO: 7103 - DNA, 201 bp, Homo sapiens
ttcagcctataccgccagctggcacaccagtccaacagcaccaatatcttcttctccccagtgagcatcgctacagcctttgcaatgctctccctggggaycaaggctgacactcacgatgaaatcctggagggcctgaatttcaacctcacggagattccggaggctcagatccatgaaggcttccaggaactcctccgt

SEQ ID NO: 7104 - DNA, 201 bp, Homo sapiens
cacccacgatatcatcaccaagttcctggaaaatgaagacagaaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggccgtgca

SEQ ID NO: 7105 - DNA, 201 bp, Homo sapiens
cgtttaggcatgtttaacatccagcactgtaagaagctgtccagctgggtgctgctgatgaaatacctgggcaatgccaccgccatcttcttcctgcctgwtgaggggaaactacagcacctggaaaatgaactcacccacgatatcatcaccaagttcctggaaaatgaagacagaaggtctgccagcttacatttaccc

SEQ ID NO: 7106 - DNA, 201 bp, Homo sapiens
accaaggctgacactcacgatgaaatcctggagggcctgaatttcaacctcacggagattccggaggctcagatccatgaaggcttccaggaactcctccrtaccctcaaccagccagacagccagctccagctgaccaccggcaatggcctgttcctcagcgagggcctgaagctagtggataagtttttggaggatgtt

SEQ ID NO: 7107 - DNA, 201 bp, Homo sapiens; identical to SEQ ID NO: 7054

SEQ ID NO: 7108 - DNA, 201 bp, Homo sapiens; identical to SEQ ID NO: 7055

SEQ ID NO: 7109 - DNA, 201 bp, Homo sapiens; identical to SEQ ID NO: 7056

SEQ ID NO: 7110 - DNA, 201 bp, Homo sapiens; identical to SEQ ID NO: 7057

SEQ ID NO: 7111 - DNA, 201 bp, Homo sapiens; identical to SEQ ID NO: 7058

SEQ ID NO: 7112 - DNA, 201 bp, Homo sapiens; identical to SEQ ID NO: 7059

SEQ ID NO: 7113 - DNA, 201 bp, Homo sapiens; identical to SEQ ID NO: 7060

SEQ ID NO: 7114 - DNA, 201 bp, Homo sapiens; identical to SEQ ID NO: 7061

SEQ ID NO: 7115 - DNA, 201 bp, Homo sapiens; identical to SEQ ID NO: 7062

SEQ ID NO: 7116 - DNA, 201 bp, Homo sapiens; identical to SEQ ID NO: 7063

SEQ ID NO: 7117 - DNA, 201 bp, Homo sapiens; identical to SEQ ID NO: 7064

SEQ ID NO: 7118 - DNA, 201 bp, Homo sapiens; identical to SEQ ID NO: 7065

SEQ ID NO: 7119 - DNA, 201 bp, Homo sapiens; identical to SEQ ID NO: 7066

SEQ ID NO: 7120 - DNA, 201 bp, Homo sapiens; identical to SEQ ID NO: 7067

SEQ ID NO: 7121 - DNA, 201 bp, Homo sapiens; identical to SEQ ID NO: 7068

SEQ ID NO: 7122 - DNA, 201 bp, Homo sapiens; identical to SEQ ID NO: 7069

SEQ ID NO: 7123 - DNA, 201 bp, Homo sapiens; identical to SEQ ID NO: 7070

SEQ ID NO: 7124 - DNA, 201 bp, Homo sapiens; identical to SEQ ID NO: 7071

SEQ ID NO: 7125 - DNA, 201 bp, Homo sapiens; identical to SEQ ID NO: 7072

SEQ ID NO: 7126 - DNA, 201 bp, Homo sapiens; identical to SEQ ID NO: 7073

SEQ ID NO: 7127 - DNA, 201 bp, Homo sapiens; identical to SEQ ID NO: 7074

SEQ ID NO: 7128 - DNA, 201 bp, Homo sapiens; identical to SEQ ID NO: 7075

SEQ ID NO: 7129 - DNA, 201 bp, Homo sapiens; identical to SEQ ID NO: 7076

SEQ ID NO: 7130 - DNA, 201 bp, Homo sapiens; identical to SEQ ID NO: 7077

SEQ ID NO: 7131 - DNA, 201 bp, Homo sapiens; identical to SEQ ID NO: 7078

SEQ ID NO: 7132 - DNA, 201 bp, Homo sapiens; identical to SEQ ID NO: 7079

SEQ ID NO: 7133 - DNA, 201 bp, Homo sapiens; identical to SEQ ID NO: 7081

SEQ ID NO: 7134 - DNA, 201 bp, Homo sapiens; identical to SEQ ID NO: 7082

SEQ ID NO: 7135 - DNA, 201 bp, Homo sapiens; identical to SEQ ID NO: 7083

SEQ ID NO: 7136 - DNA, 201 bp, Homo sapiens; identical to SEQ ID NO: 7084

SEQ ID NO: 7137 - DNA, 201 bp, Homo sapiens; identical to SEQ ID NO: 7085

SEQ ID NO: 7138 - DNA, 201 bp, Homo sapiens; identical to SEQ ID NO: 7086

SEQ ID NO: 7139 - DNA, 201 bp, Homo sapiens; identical to SEQ ID NO: 7087

SEQ ID NO: 7140 - DNA, 201 bp, Homo sapiens; identical to SEQ ID NO: 7088

SEQ ID NO: 7141 - DNA, 201 bp, Homo sapiens; identical to SEQ ID NO: 7089

SEQ ID NO: 7142 - DNA, 201 bp, Homo sapiens; identical to SEQ ID NO: 7090

SEQ ID NO: 7143 - DNA, 201 bp, Homo sapiens; identical to SEQ ID NO: 7091

SEQ ID NO: 7144 - DNA, 201 bp, Homo sapiens; identical to SEQ ID NO: 7092

SEQ ID NO: 7145 - DNA, 201 bp, Homo sapiens; identical to SEQ ID NO: 7093

SEQ ID NO: 7146 - DNA, 201 bp, Homo sapiens; identical to SEQ ID NO: 7094

SEQ ID NO: 7147 - DNA, 201 bp, Homo sapiens; identical to SEQ ID NO: 7095

SEQ ID NO: 7148 - DNA, 201 bp, Homo sapiens; identical to SEQ ID NO: 7096

SEQ ID NO: 7149 - DNA, 201 bp, Homo sapiens; identical to SEQ ID NO: 7097

SEQ ID NO: 7150 - DNA, 201 bp, Homo sapiens; identical to SEQ ID NO: 7098

SEQ ID NO: 7151 - DNA, 201 bp, Homo sapiens; identical to SEQ ID NO: 7099

SEQ ID NO: 7152 - DNA, 201 bp, Homo sapiens; identical to SEQ ID NO: 7100

SEQ ID NO: 7153 - DNA, 201 bp, Homo sapiens; identical to SEQ ID NO: 7101

SEQ ID NO: 7154 - DNA, 201 bp, Homo sapiens; identical to SEQ ID NO: 7102

SEQ ID NO: 7155 - DNA, 201 bp, Homo sapiens; identical to SEQ ID NO: 7103

SEQ ID NO: 7156 - DNA, 201 bp, Homo sapiens; identical to SEQ ID NO: 7104

SEQ ID NO: 7157 - DNA, 201 bp, Homo sapiens; identical to SEQ ID NO: 7105

SEQ ID NO: 7158 - DNA, 201 bp, Homo sapiens; identical to SEQ ID NO: 7106

SEQ ID NO: 7159 - DNA, 201 bp, Homo sapiens; identical to SEQ ID NO: 7054

SEQ ID NO: 7160 - DNA, 201 bp, Homo sapiens; identical to SEQ ID NO: 7055

SEQ ID NO: 7161 - DNA, 201 bp, Homo sapiens; identical to SEQ ID NO: 7056

SEQ ID NO: 7162 - DNA, 201 bp, Homo sapiens; identical to SEQ ID NO: 7057

SEQ ID NO: 7163 - DNA, 201 bp, Homo sapiens; identical to SEQ ID NO: 7058

SEQ ID NO: 7164 - DNA, 201 bp, Homo sapiens; identical to SEQ ID NO: 7059

SEQ ID NO: 7165 - DNA, 201 bp, Homo sapiens; identical to SEQ ID NO: 7060

SEQ ID NO: 7166 - DNA, 201 bp, Homo sapiens; identical to SEQ ID NO: 7061

SEQ ID NO: 7167 - DNA, 201 bp, Homo sapiens; identical to SEQ ID NO: 7062

SEQ ID NO: 7168 - DNA, 201 bp, Homo sapiens; identical to SEQ ID NO: 7063

SEQ ID NO: 7169 - DNA, 201 bp, Homo sapiens; identical to SEQ ID NO: 7064

SEQ ID NO: 7170 - DNA, 201 bp, Homo sapiens; identical to SEQ ID NO: 7066

SEQ ID NO: 7171 - DNA, 201 bp, Homo sapiens; identical to SEQ ID NO: 7067

SEQ ID NO: 7172 - DNA, 201 bp, Homo sapiens; identical to SEQ ID NO: 7068

SEQ ID NO: 7173 - DNA, 201 bp, Homo sapiens; identical to SEQ ID NO: 7069

SEQ ID NO: 7174 - DNA, 201 bp, Homo sapiens; identical to SEQ ID NO: 7070

SEQ ID NO: 7175 - DNA, 201 bp, Homo sapiens; identical to SEQ ID NO: 7071

SEQ ID NO: 7176 - DNA, 201 bp, Homo sapiens; identical to SEQ ID NO: 7073

SEQ ID NO: 7177 - DNA, 201 bp, Homo sapiens; identical to SEQ ID NO: 7074

SEQ ID NO: 7178 - DNA, 201 bp, Homo sapiens; identical to SEQ ID NO: 7075

SEQ ID NO: 7179 - DNA, 201 bp, Homo sapiens; identical to SEQ ID NO: 7076

SEQ ID NO: 7180 - DNA, 201 bp, Homo sapiens; identical to SEQ ID NO: 7077

SEQ ID NO: 7181 - DNA, 201 bp, Homo sapiens; identical to SEQ ID NO: 7078

SEQ ID NO: 7182 - DNA, 201 bp, Homo sapiens; identical to SEQ ID NO: 7079

SEQ ID NO: 7183 - DNA, 201 bp, Homo sapiens; identical to SEQ ID NO: 7081

SEQ ID NO: 7184 - DNA, 201 bp, Homo sapiens; identical to SEQ ID NO: 7082

SEQ ID NO: 7185 - DNA, 201 bp, Homo sapiens; identical to SEQ ID NO: 7083

SEQ ID NO: 7186 - DNA, 201 bp, Homo sapiens; identical to SEQ ID NO: 7084

SEQ ID NO: 7187 - DNA, 201 bp, Homo sapiens; identical to SEQ ID NO: 7085

SEQ ID NO: 7188 - DNA, 201 bp, Homo sapiens; identical to SEQ ID NO: 7086

SEQ ID NO: 7189 - DNA, 201 bp, Homo sapiens; identical to SEQ ID NO: 7087

SEQ ID NO: 7190 - DNA, 201 bp, Homo sapiens; identical to SEQ ID NO: 7088

SEQ ID NO: 7191 - DNA, 201 bp, Homo sapiens; identical to SEQ ID NO: 7089

SEQ ID NO: 7192 - DNA, 201 bp, Homo sapiens; identical to SEQ ID NO: 7090

SEQ ID NO: 7193 - DNA, 201 bp, Homo sapiens; identical to SEQ ID NO: 7091

SEQ ID NO: 7194 - DNA, 201 bp, Homo sapiens; identical to SEQ ID NO: 7092

SEQ ID NO: 7195 - DNA, 201 bp, Homo sapiens; identical to SEQ ID NO: 7093

SEQ ID NO: 7196 - DNA, 201 bp, Homo sapiens; identical to SEQ ID NO: 7094

SEQ ID NO: 7197 - DNA, 201 bp, Homo sapiens; identical to SEQ ID NO: 7095

SEQ ID NO: 7198 - DNA, 201 bp, Homo sapiens
ttcaaggagagatgagcgtctctaaagcccctgacagcaagagcccagaactgggacaccattagtgacccagacggcaggacaatgccgtcttctgtctygtggggcatcctcctgctggcaggcctgtgctgcctggtccctgtctccctggctgaggatccccagggagatgctgcccagaagacagatacatcccac

SEQ ID NO: 7199 - DNA, 201 bp, Homo sapiens; identical to SEQ ID NO: 7097

SEQ ID NO: 7200 - DNA, 201 bp, Homo sapiens; identical to SEQ ID NO: 7098

SEQ ID NO: 7201 - DNA, 201 bp, Homo sapiens; identical to SEQ ID NO: 7099

SEQ ID NO: 7202 - DNA, 201 bp, Homo sapiens; identical to SEQ ID NO: 7100

SEQ ID NO: 7203 - DNA, 201 bp, Homo sapiens; identical to SEQ ID NO: 7101

SEQ ID NO: 7204 - DNA, 201 bp, Homo sapiens; identical to SEQ ID NO: 7102

SEQ ID NO: 7205 - DNA, 201 bp, Homo sapiens; identical to SEQ ID NO: 7103

SEQ ID NO: 7206 - DNA, 201 bp, Homo sapiens; identical to SEQ ID NO: 7104

SEQ ID NO: 7207 - DNA, 201 bp, Homo sapiens; identical to SEQ ID NO: 7105

SEQ ID NO: 7208 - DNA, 201 bp, Homo sapiens; identical to SEQ ID NO: 7106

SEQ ID NO: 7209 - DNA, 201 bp, Homo sapiens; identical to SEQ ID NO: 7054

SEQ ID NO: 7210 - DNA, 201 bp, Homo sapiens
ctcctcagcttcaggcaccaccactgacctgggacagtgaatctgttactgatgtcggcaagtacttggcacaggctggtttaataatccctaggcacttycacgtggtgtcaatccctgatcactgggagtcatcatgtgccttgactcggggcctggcccccccatctctgtcttgcaggacaatgccgtcttctgtct

SEQ ID NO: 7211 - DNA, 201 bp, Homo sapiens; identical to SEQ ID NO: 7055

SEQ ID NO: 7212 - DNA, 201 bp, Homo sapiens; identical to SEQ ID NO: 7056

SEQ ID NO: 7213 - DNA, 201 bp, Homo sapiens; identical to SEQ ID NO: 7057

SEQ ID NO: 7214 - DNA, 201 bp, Homo sapiens; identical to SEQ ID NO: 7058

SEQ ID NO: 7215 - DNA, 201 bp, Homo sapiens; identical to SEQ ID NO: 7059

SEQ ID NO: 7216 - DNA, 201 bp, Homo sapiens; identical to SEQ ID NO: 7060

SEQ ID NO: 7217 - DNA, 201 bp, Homo sapiens; identical to SEQ ID NO: 7061

SEQ ID NO: 7218 - DNA, 201 bp, Homo sapiens; identical to SEQ ID NO: 7062

SEQ ID NO: 7219 - DNA, 201 bp, Homo sapiens; identical to SEQ ID NO: 7063

SEQ ID NO: 7220 - DNA, 201 bp, Homo sapiens; identical to SEQ ID NO: 7064

SEQ ID NO: 7221 - DNA, 201 bp, Homo sapiens; identical to SEQ ID NO: 7066

SEQ ID NO: 7222 - DNA, 201 bp, Homo sapiens; identical to SEQ ID NO: 7067

SEQ ID NO: 7223 - DNA, 201 bp, Homo sapiens; identical to SEQ ID NO: 7068

SEQ ID NO: 7224 - DNA, 201 bp, Homo sapiens; identical to SEQ ID NO: 7069

SEQ ID NO: 7225 - DNA, 201 bp, Homo sapiens; identical to SEQ ID NO: 7070

SEQ ID NO: 7226 - DNA, 201 bp, Homo sapiens; identical to SEQ ID NO: 7071

SEQ ID NO: 7227 - DNA, 201 bp, Homo sapiens; identical to SEQ ID NO: 7073

SEQ ID NO: 7228 - DNA, 201 bp, Homo sapiens; identical to SEQ ID NO: 7074

SEQ ID NO: 7229 - DNA, 201 bp, Homo sapiens; identical to SEQ ID NO: 7075

SEQ ID NO: 7230 - DNA, 201 bp, Homo sapiens; identical to SEQ ID NO: 7076

SEQ ID NO: 7231 - DNA, 201 bp, Homo sapiens; identical to SEQ ID NO: 7077

SEQ ID NO: 7232 - DNA, 201 bp, Homo sapiens; identical to SEQ ID NO: 7078

SEQ ID NO: 7233 - DNA, 201 bp, Homo sapiens; identical to SEQ ID NO: 7079

SEQ ID NO: 7234 - DNA, 201 bp, Homo sapiens
tgtctcctcagcttcaggcaccaccactgacctgggacagtgaatctgttactgatgtcggcaagtacttggcacaggctggtttaataatccctaggcayttccacgtggtgtcaatccctgatcactgggagtcatcatgtgccttgactcggggcctggcccccccatctctgtcttgcaggacaatgccgtcttctg

SEQ ID NO: 7235 - DNA, 201 bp, Homo sapiens; identical to SEQ ID NO: 7081

SEQ ID NO: 7236 - DNA, 201 bp, Homo sapiens; identical to SEQ ID NO: 7082

SEQ ID NO: 7237 - DNA, 201 bp, Homo sapiens; identical to SEQ ID NO: 7083

SEQ ID NO: 7238 - DNA, 201 bp, Homo sapiens; identical to SEQ ID NO: 7084

SEQ ID NO: 7239 - DNA, 201 bp, Homo sapiens; identical to SEQ ID NO: 7085

SEQ ID NO: 7240 - DNA, 201 bp, Homo sapiens; identical to SEQ ID NO: 7086

SEQ ID NO: 7241 - DNA, 201 bp, Homo sapiens; identical to SEQ ID NO: 7087

SEQ ID NO: 7242 - DNA, 201 bp, Homo sapiens; identical to SEQ ID NO: 7088

SEQ ID NO: 7243 - DNA, 201 bp, Homo sapiens; identical to SEQ ID NO: 7089

SEQ ID NO: 7244 - DNA, 201 bp, Homo sapiens; identical to SEQ ID NO: 7090

SEQ ID NO: 7245 - DNA, 201 bp, Homo sapiens; identical to SEQ ID NO: 7091

SEQ ID NO: 7246 - DNA, 201 bp, Homo sapiens; identical to SEQ ID NO: 7092

SEQ ID NO: 7247 - DNA, 201 bp, Homo sapiens; identical to SEQ ID NO: 7093

SEQ ID NO: 7248 - DNA, 201 bp, Homo sapiens; identical to SEQ ID NO: 7094

SEQ ID NO: 7249 - DNA, 201 bp, Homo sapiens; identical to SEQ ID NO: 7095

SEQ ID NO: 7250 - DNA, 201 bp, Homo sapiens
cacgtggtgtcaatccctgatcactgggagtcatcatgtgccttgactcggggcctggcccccccatctctgtcttgcaggacaatgccgtcttctgtctygtggggcatcctcctgctggcaggcctgtgctgcctggtccctgtctccctggctgaggatccccagggagatgctgcccagaagacagatacatcccac

SEQ ID NO: 7251 - DNA, 201 bp, Homo sapiens; identical to SEQ ID NO: 7097

SEQ ID NO: 7252 - DNA, 201 bp, Homo sapiens; identical to SEQ ID NO: 7098

SEQ ID NO: 7253 - DNA, 201 bp, Homo sapiens; identical to SEQ ID NO: 7099

SEQ ID NO: 7254 - DNA, 201 bp, Homo sapiens; identical to SEQ ID NO: 7100

SEQ ID NO: 7255 - DNA, 201 bp, Homo sapiens; identical to SEQ ID NO: 7101

SEQ ID NO: 7256 - DNA, 201 bp, Homo sapiens; identical to SEQ ID NO: 7102

SEQ ID NO: 7257 - DNA, 201 bp, Homo sapiens; identical to SEQ ID NO: 7103

SEQ ID NO: 7258 - DNA, 201 bp, Homo sapiens; identical to SEQ ID NO: 7104

SEQ ID NO: 7259 - DNA, 201 bp, Homo sapiens; identical to SEQ ID NO: 7105

SEQ ID NO: 7260 - DNA, 201 bp, Homo sapiens; identical to SEQ ID NO: 7106

SEQ ID NO: 7261 - DNA, 201 bp, Homo sapiens; identical to SEQ ID NO: 7054

SEQ ID NO: 7262 - DNA, 201 bp, Homo sapiens; identical to SEQ ID NO: 7055

SEQ ID NO: 7263 - DNA, 201 bp, Homo sapiens; identical to SEQ ID NO: 7056

SEQ ID NO: 7264 - DNA, 201 bp, Homo sapiens; identical to SEQ ID NO: 7057

SEQ ID NO: 7265 - DNA, 201 bp, Homo sapiens; identical to SEQ ID NO: 7058

SEQ ID NO: 7266 - DNA, 201 bp, Homo sapiens; identical to SEQ ID NO: 7059

SEQ ID NO: 7267 - DNA, 201 bp, Homo sapiens; identical to SEQ ID NO: 7060

SEQ ID NO: 7268 - DNA, 201 bp, Homo sapiens; identical to SEQ ID NO: 7061

SEQ ID NO: 7269 - DNA, 201 bp, Homo sapiens; identical to SEQ ID NO: 7062

SEQ ID NO: 7270 - DNA, 201 bp, Homo sapiens; identical to SEQ ID NO: 7063

SEQ ID NO: 7271 - DNA, 201 bp, Homo sapiens; identical to SEQ ID NO: 7064

SEQ ID NO: 7272 - DNA, 201 bp, Homo sapiens; identical to SEQ ID NO: 7065

SEQ ID NO: 7273 - DNA, 201 bp, Homo sapiens; identical to SEQ ID NO: 7066

SEQ ID NO: 7274 - DNA, 201 bp, Homo sapiens; identical to SEQ ID NO: 7067

SEQ ID NO: 7275 - DNA, 201 bp, Homo sapiens; identical to SEQ ID NO: 7068

SEQ ID NO: 7276 - DNA, 201 bp, Homo sapiens; identical to SEQ ID NO: 7069

SEQ ID NO: 7277 - DNA, 201 bp, Homo sapiens; identical to SEQ ID NO: 7070

SEQ ID NO: 7278 - DNA, 201 bp, Homo sapiens; identical to SEQ ID NO: 7071

SEQ ID NO: 7279 - DNA, 201 bp, Homo sapiens; identical to SEQ ID NO: 7072

SEQ ID NO: 7280 - DNA, 201 bp, Homo sapiens; identical to SEQ ID NO: 7073

SEQ ID NO: 7281 - DNA, 201 bp, Homo sapiens; identical to SEQ ID NO: 7074

SEQ ID NO: 7282 - DNA, 201 bp, Homo sapiens; identical to SEQ ID NO: 7075

SEQ ID NO: 7283 - DNA, 201 bp, Homo sapiens; identical to SEQ ID NO: 7076

SEQ ID NO: 7284 - DNA, 201 bp, Homo sapiens; identical to SEQ ID NO: 7077

SEQ ID NO: 7285 - DNA, 201 bp, Homo sapiens; identical to SEQ ID NO: 7078

SEQ ID NO: 7286 - DNA, 201 bp, Homo sapiens; identical to SEQ ID NO: 7079

SEQ ID NO: 7287 - DNA, 201 bp, Homo sapiens; identical to SEQ ID NO: 7081

SEQ ID NO: 7288 - DNA, 201 bp, Homo sapiens; identical to SEQ ID NO: 7082

SEQ ID NO: 7289 - DNA, 201 bp, Homo sapiens; identical to SEQ ID NO: 7083

SEQ ID NO: 7290 - DNA, 201 bp, Homo sapiens; identical to SEQ ID NO: 7084

SEQ ID NO: 7291 - DNA, 201 bp, Homo sapiens; identical to SEQ ID NO: 7085

SEQ ID NO: 7292 - DNA, 201 bp, Homo sapiens; identical to SEQ ID NO: 7086

SEQ ID NO: 7293 - DNA, 201 bp, Homo sapiens; identical to SEQ ID NO: 7087

SEQ ID NO: 7294 - DNA, 201 bp, Homo sapiens; identical to SEQ ID NO: 7088

SEQ ID NO: 7295 - DNA, 201 bp, Homo sapiens; identical to SEQ ID NO: 7089

SEQ ID NO: 7296 - DNA, 201 bp, Homo sapiens; identical to SEQ ID NO: 7090

SEQ ID NO: 7297 - DNA, 201 bp, Homo sapiens; identical to SEQ ID NO: 7091

SEQ ID NO: 7298 - DNA, 201 bp, Homo sapiens; identical to SEQ ID NO: 7092

SEQ ID NO: 7299 - DNA, 201 bp, Homo sapiens; identical to SEQ ID NO: 7093

SEQ ID NO: 7300 - DNA, 201 bp, Homo sapiens; identical to SEQ ID NO: 7094

SEQ ID NO: 7301 - DNA, 201 bp, Homo sapiens; identical to SEQ ID NO: 7095

SEQ ID NO: 7302 - DNA, 201 bp, Homo sapiens
ctcctgccagccttcaggccactctcctgtgcctgccagaagagacagagcttgaggagagcttgaggagagcaggaaaggacaatgccgtcttctgtctygtggggcatcctcctgctggcaggcctgtgctgcctggtccctgtctccctggctgaggatccccagggagatgctgcccagaagacagatacatcccac

SEQ ID NO: 7303 - DNA, 201 bp, Homo sapiens; identical to SEQ ID NO: 7097

SEQ ID NO: 7304 - DNA, 201 bp, Homo sapiens; identical to SEQ ID NO: 7098

SEQ ID NO: 7305 - DNA, 201 bp, Homo sapiens; identical to SEQ ID NO: 7099

SEQ ID NO: 7306 - DNA, 201 bp, Homo sapiens; identical to SEQ ID NO: 7100

SEQ ID NO: 7307 - DNA, 201 bp, Homo sapiens; identical to SEQ ID NO: 7101

SEQ ID NO: 7308 - DNA, 201 bp, Homo sapiens; identical to SEQ ID NO: 7102

SEQ ID NO: 7309 - DNA, 201 bp, Homo sapiens; identical to SEQ ID NO: 7103

SEQ ID NO: 7310 - DNA, 201 bp, Homo sapiens; identical to SEQ ID NO: 7104

SEQ ID NO: 7311 - DNA, 201 bp, Homo sapiens; identical to SEQ ID NO: 7105

SEQ ID NO: 7312 - DNA, 201 bp, Homo sapiens; identical to SEQ ID NO: 7106

SEQ ID NO: 7313 - DNA, 201 bp, Homo sapiens; identical to SEQ ID NO: 7054

SEQ ID NO: 7314 - DNA, 201 bp, Homo sapiens; identical to SEQ ID NO: 7055

SEQ ID NO: 7315 - DNA, 201 bp, Homo sapiens; identical to SEQ ID NO: 7056

SEQ ID NO: 7316 - DNA, 201 bp, Homo sapiens; identical to SEQ ID NO: 7057

SEQ ID NO: 7317 - DNA, 201 bp, Homo sapiens; identical to SEQ ID NO: 7058

SEQ ID NO: 7318 - DNA, 201 bp, Homo sapiens; identical to SEQ ID NO: 7059

SEQ ID NO: 7319 - DNA, 201 bp, Homo sapiens; identical to SEQ ID NO: 7060

SEQ ID NO: 7320 - DNA, 201 bp, Homo sapiens; identical to SEQ ID NO: 7061

SEQ ID NO: 7321 - DNA, 201 bp, Homo sapiens; identical to SEQ ID NO: 7062

SEQ ID NO: 7322 - DNA, 201 bp, Homo sapiens; identical to SEQ ID NO: 7063

SEQ ID NO: 7323 - DNA, 201 bp, Homo sapiens; identical to SEQ ID NO: 7064

SEQ ID NO: 7324 - DNA, 201 bp, Homo sapiens; identical to SEQ ID NO: 7065

SEQ ID NO: 7325 - DNA, 201 bp, Homo sapiens; identical to SEQ ID NO: 7066

SEQ ID NO: 7326 - DNA, 201 bp, Homo sapiens; identical to SEQ ID NO: 7067

SEQ ID NO: 7327 - DNA, 201 bp, Homo sapiens; identical to SEQ ID NO: 7068

SEQ ID NO: 7328 - DNA, 201 bp, Homo sapiens; identical to SEQ ID NO: 7069

SEQ ID NO: 7329 - DNA, 201 bp, Homo sapiens; identical to SEQ ID NO: 7070

SEQ ID NO: 7330 - DNA, 201 bp, Homo sapiens; identical to SEQ ID NO: 7071

SEQ ID NO: 7331 - DNA, 201 bp, Homo sapiens; identical to SEQ ID NO: 7072

SEQ ID NO: 7332 - DNA, 201 bp, Homo sapiens; identical to SEQ ID NO: 7073

SEQ ID NO: 7333 - DNA, 201 bp, Homo sapiens; identical to SEQ ID NO: 7074

SEQ ID NO: 7334 - DNA, 201 bp, Homo sapiens; identical to SEQ ID NO: 7075

SEQ ID NO: 7335 - DNA, 201 bp, Homo sapiens; identical to SEQ ID NO: 7076

SEQ ID NO: 7336 - DNA, 201 bp, Homo sapiens; identical to SEQ ID NO: 7077

SEQ ID NO: 7337 - DNA, 201 bp, Homo sapiens; identical to SEQ ID NO: 7078

SEQ ID NO: 7338 - DNA, 201 bp, Homo sapiens; identical to SEQ ID NO: 7079

SEQ ID NO: 7339 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcgcagcctcccccgttgcccctctggatc

SEQ ID NO: 7340 - DNA, 201 bp, Homo sapiens; identical to SEQ ID NO: 7081

SEQ ID NO: 7341 - DNA, 201 bp, Homo sapiens; identical to SEQ ID NO: 7082

SEQ ID NO: 7342 - DNA, 201 bp, Homo sapiens; identical to SEQ ID NO: 7083

SEQ ID NO: 7343 - DNA, 201 bp, Homo sapiens; identical to SEQ ID NO: 7084

SEQ ID NO: 7344 - DNA, 201 bp, Homo sapiens; identical to SEQ ID NO: 7085

SEQ ID NO: 7345 - DNA, 201 bp, Homo sapiens; identical to SEQ ID NO: 7086

SEQ ID NO: 7346 - DNA, 201 bp, Homo sapiens; identical to SEQ ID NO: 7087

SEQ ID NO: 7347 - DNA, 201 bp, Homo sapiens; identical to SEQ ID NO: 7088

SEQ ID NO: 7348 - DNA, 201 bp, Homo sapiens; identical to SEQ ID NO: 7089

SEQ ID NO: 7349 - DNA, 201 bp, Homo sapiens; identical to SEQ ID NO: 7090

SEQ ID NO: 7350 - DNA, 201 bp, Homo sapiens; identical to SEQ ID NO: 7091

SEQ ID NO: 7351 - DNA, 201 bp, Homo sapiens; identical to SEQ ID NO: 7092

SEQ ID NO: 7352 - DNA, 201 bp, Homo sapiens; identical to SEQ ID NO: 7093

SEQ ID NO: 7353 - DNA, 201 bp, Homo sapiens; identical to SEQ ID NO: 7094

SEQ ID NO: 7354 - DNA, 201 bp, Homo sapiens; identical to SEQ ID NO: 7095

SEQ ID NO: 7355 - DNA, 201 bp, Homo sapiens; identical to SEQ ID NO: 7096

SEQ ID NO: 7356 - DNA, 201 bp, Homo sapiens; identical to SEQ ID NO: 7097

SEQ ID NO: 7357 - DNA, 201 bp, Homo sapiens; identical to SEQ ID NO: 7098

SEQ ID NO: 7358 - DNA, 201 bp, Homo sapiens; identical to SEQ ID NO: 7099

SEQ ID NO: 7359 - DNA, 201 bp, Homo sapiens; identical to SEQ ID NO: 7100

SEQ ID NO: 7360 - DNA, 201 bp, Homo sapiens; identical to SEQ ID NO: 7101

SEQ ID NO: 7361 - DNA, 201 bp, Homo sapiens; identical to SEQ ID NO: 7102

SEQ ID NO: 7362 - DNA, 201 bp, Homo sapiens; identical to SEQ ID NO: 7103

SEQ ID NO: 7363 - DNA, 201 bp, Homo sapiens; identical to SEQ ID NO: 7104

SEQ ID NO: 7364 - DNA, 201 bp, Homo sapiens; identical to SEQ ID NO: 7105

SEQ ID NO: 7365 - DNA, 201 bp, Homo sapiens; identical to SEQ ID NO: 7106

SEQ ID NO: 7366 - DNA, 201 bp, Homo sapiens; identical to SEQ ID NO: 7054

SEQ ID NO: 7367 - DNA, 201 bp, Homo sapiens; identical to SEQ ID NO: 7055

SEQ ID NO: 7368 - DNA, 201 bp, Homo sapiens; identical to SEQ ID NO: 7056

SEQ ID NO: 7369 - DNA, 201 bp, Homo sapiens; identical to SEQ ID NO: 7057

SEQ ID NO: 7370 - DNA, 201 bp, Homo sapiens; identical to SEQ ID NO: 7058

SEQ ID NO: 7371 - DNA, 201 bp, Homo sapiens; identical to SEQ ID NO: 7059

SEQ ID NO: 7372 - DNA, 201 bp, Homo sapiens; identical to SEQ ID NO: 7060

SEQ ID NO: 7373 - DNA, 201 bp, Homo sapiens; identical to SEQ ID NO: 7061

SEQ ID NO: 7374 - DNA, 201 bp, Homo sapiens; identical to SEQ ID NO: 7062

SEQ ID NO: 7375 - DNA, 201 bp, Homo sapiens; identical to SEQ ID NO: 7063

SEQ ID NO: 7376 - DNA, 201 bp, Homo sapiens; identical to SEQ ID NO: 7064

SEQ ID NO: 7377 - DNA, 201 bp, Homo sapiens; identical to SEQ ID NO: 7066

SEQ ID NO: 7378 - DNA, 201 bp, Homo sapiens; identical to SEQ ID NO: 7067

SEQ ID NO: 7379 - DNA, 201 bp, Homo sapiens; identical to SEQ ID NO: 7068

SEQ ID NO: 7380 - DNA, 201 bp, Homo sapiens; identical to SEQ ID NO: 7069

SEQ ID NO: 7381 - DNA, 201 bp, Homo sapiens; identical to SEQ ID NO: 7070

SEQ ID NO: 7382 - DNA, 201 bp, Homo sapiens; identical to SEQ ID NO: 7071

SEQ ID NO: 7383 - DNA, 201 bp, Homo sapiens; identical to SEQ ID NO: 7073

SEQ ID NO: 7384 - DNA, 201 bp, Homo sapiens; identical to SEQ ID NO: 7074

SEQ ID NO: 7385 - DNA, 201 bp, Homo sapiens; identical to SEQ ID NO: 7075

SEQ ID NO: 7386 - DNA, 201 bp, Homo sapiens; identical to SEQ ID NO: 7076

SEQ ID NO: 7387 - DNA, 201 bp, Homo sapiens; identical to SEQ ID NO: 7077

SEQ ID NO: 7388 - DNA, 201 bp, Homo sapiens; identical to SEQ ID NO: 7078

SEQ ID NO: 7389 - DNA, 201 bp, Homo sapiens; identical to SEQ ID NO: 7079

SEQ ID NO: 7390 - DNA, 201 bp, Homo sapiens; identical to SEQ ID NO: 7081

SEQ ID NO: 7391 - DNA, 201 bp, Homo sapiens; identical to SEQ ID NO: 7082

SEQ ID NO: 7392 - DNA, 201 bp, Homo sapiens; identical to SEQ ID NO: 7083

SEQ ID NO: 7393 - DNA, 201 bp, Homo sapiens; identical to SEQ ID NO: 7084

SEQ ID NO: 7394 - DNA, 201 bp, Homo sapiens; identical to SEQ ID NO: 7085

SEQ ID NO: 7395 - DNA, 201 bp, Homo sapiens; identical to SEQ ID NO: 7086

SEQ ID NO: 7396 - DNA, 201 bp, Homo sapiens; identical to SEQ ID NO: 7087

SEQ ID NO: 7397 - DNA, 201 bp, Homo sapiens; identical to SEQ ID NO: 7088

SEQ ID NO: 7398 - DNA, 201 bp, Homo sapiens; identical to SEQ ID NO: 7089

SEQ ID NO: 7399 - DNA, 201 bp, Homo sapiens; identical to SEQ ID NO: 7090

SEQ ID NO: 7400 - DNA, 201 bp, Homo sapiens; identical to SEQ ID NO: 7091

SEQ ID NO: 7401 - DNA, 201 bp, Homo sapiens; identical to SEQ ID NO: 7092

SEQ ID NO: 7402 - DNA, 201 bp, Homo sapiens; identical to SEQ ID NO: 7093

SEQ ID NO: 7403 - DNA, 201 bp, Homo sapiens; identical to SEQ ID NO: 7094

SEQ ID NO: 7404 - DNA, 201 bp, Homo sapiens; identical to SEQ ID NO: 7095

SEQ ID NO: 7405 - DNA, 201 bp, Homo sapiens; identical to SEQ ID NO: 7096

SEQ ID NO: 7406 - DNA, 201 bp, Homo sapiens; identical to SEQ ID NO: 7097

SEQ ID NO: 7407 - DNA, 201 bp, Homo sapiens; identical to SEQ ID NO: 7098

SEQ ID NO: 7408 - DNA, 201 bp, Homo sapiens; identical to SEQ ID NO: 7099

SEQ ID NO: 7409 - DNA, 201 bp, Homo sapiens; identical to SEQ ID NO: 7100

SEQ ID NO: 7410 - DNA, 201 bp, Homo sapiens; identical to SEQ ID NO: 7101

SEQ ID NO: 7411 - DNA, 201 bp, Homo sapiens; identical to SEQ ID NO: 7102

SEQ ID NO: 7412 - DNA, 201 bp, Homo sapiens; identical to SEQ ID NO: 7103

SEQ ID NO: 7413 - DNA, 201 bp, Homo sapiens; identical to SEQ ID NO: 7104

SEQ ID NO: 7414 - DNA, 201 bp, Homo sapiens; identical to SEQ ID NO: 7105

SEQ ID NO: 7415 - DNA, 201 bp, Homo sapiens; identical to SEQ ID NO: 7106

SEQ ID NO: 7416 - DNA, 201 bp, Homo sapiens
tatttctgaaatcaggtcaaggagagcctctggatgactatgtgaatacccagggggcttcactgttcagtgtcactaagaagcagctgggagcaggaagyatagaagaatgtgcagcaaaatgtgaggaggacgaagaattcacctgcagggcattccaatatcacagtaaagagcaacaatgtgtgataatggctgaaa

SEQ ID NO: 7417 - DNA, 201 bp, Homo sapiens
cagtcccaaaatggaacataaggaagtggttcttctacttcttttatttctgaaatcaggtcaaggagagcctctggatgactatgtgaatacccaggggscttcactgttcagtgtcactaagaagcagctgggagcaggaagtatagaagaatgtgcagcaaaatgtgaggaggacgaagaattcacctgcagggcatt

SEQ ID NO: 7418 - DNA, 155 bp, Homo sapiens
ggtttgtggatgcgtttactctcatgtaagtcaacaacatcctgggattgggacmcactttctgggcactgctggccagtcccaaaatggaacataaggaagtggttcttctacttcttttatttctgaaatcaggtcaaggagagcctctggat

SEQ ID NO: 7419 - DNA, 201 bp, Homo sapiens
gaattcacctgcagggcattccaatatcacagtaaagagcaacaatgtgtgataatggctgaaaacaggaagtcctccataatcattaggatgagagatgyagttttatttgaaaagaaagtgtatctctcagagtgcaagactgggaatggaaagaactacagagggacgatgtccaaaacaaaaaatggcatcacctgt

SEQ ID NO: 7420 - DNA, 201 bp, Homo sapiens
actgctggccagtcccaaaatggaacataaggaagtggttcttctacttcttttatttctgaaatcaggtcaaggagagcctctggatgactatgtgaatrcccagggggcttcactgttcagtgtcactaagaagcagctgggagcaggaagtatagaagaatgtgcagcaaaatgtgaggaggacgaagaattcacctg

SEQ ID NO: 7421 - DNA, 138 bp, Homo sapiens
ggtttgtggatgcgtttactctcatgtaagtcaacaayatcctgggattgggacccactttctgggcactgctggccagtcccaaaatggaacataaggaagtggttcttctacttcttttatttctgaaatcaggtc

SEQ ID NO: 7422 - DNA, 201 bp, Homo sapiens
gggcactgctggccagtcccaaaatggaacataaggaagtggttcttctacttcttttatttctgaaatcaggtcaaggagagcctctggatgactatgtraatacccagggggcttcactgttcagtgtcactaagaagcagctgggagcaggaagtatagaagaatgtgcagcaaaatgtgaggaggacgaagaattca

SEQ ID NO: 7423 - DNA, 104 bp, Homo sapiens
ggtytgtggatgcgtttactctcatgtaagtcaacaacatcctgggattgggacccactttctgggcactgctggccagtcccaaaatggaacataaggaagtg

SEQ ID NO: 7424 - DNA, 115 bp, Homo sapiens
tgactatgtttgggactgaagtaagcatatcaagttagaactctcatcacatgttcgactcaaattgtggagcaaaagagtaaataagatataaaaatgamaatgaagatacgtg

SEQ ID NO: 7425 - DNA, 201 bp, Homo sapiens
atccacagttggttgaatttgtggatctggaacccatggatacagagggccaactgtatttaggataatttcatcacttttaattcaaaccacaatatgtraataagcagatagaaagaatctttttgatgtcgatgttcaactatttttggcaccatagtagaacatggttgctttctattttttcttggatatggaggt

SEQ ID NO: 7426 - DNA, 201 bp, Homo sapiens
ttatactgtattgtttttatttgtattatgttttattgtcatattgttattttctgtcatctttttcaagtcttttccatccacagttggttgaatttgtkgatctggaacccatggatacagagggccaactgtatttaggataatttcatcacttttaattcaaaccacaatatgtgaataagcagatagaaagaatct

SEQ ID NO: 7427 - DNA, 201 bp, Homo sapiens
acagtaaagagcaacaatgtgtgataatggctgaaaacaggaagtcctccataatcattaggatgagagatgtagttttatttgaaaagaaagtgtatctytcagagtgcaagactgggaatggaaagaactacagagggacgatgtccaaaacaaaaaatggcatcacctgtcaaaaatggagttccacttctccccaca

SEQ ID NO: 7428 - DNA, 201 bp, Homo sapiens
gaatggaaagaactacagagggacgatgtccaaaacaaaaaatggcatcacctgtcaaaaatggagttccacttctccccacagacctaggtaagacattycctttcatctttgtgttcatctactgtaaagttgtccctctgtgtctgtgagggattggttccaggacccctgtggctaccaaaatccatgcttctcaag

SEQ ID NO: 7429 - DNA, 201 bp, Homo sapiens
ctctcagagtgcaagactgggaatggaaagaactacagagggacgatgtccaaaacaaaaaatggcatcacctgtcaaaaatggagttccacttctccccrcagacctaggtaagacattccctttcatctttgtgttcatctactgtaaagttgtccctctgtgtctgtgagggattggttccaggacccctgtggctac

SEQ ID NO: 7430 - DNA, 201 bp, Homo sapiens
tcagagtgcaagactgggaatggaaagaactacagagggacgatgtccaaaacaaaaaatggcatcacctgtcaaaaatggagttccacttctccccacaracctaggtaagacattccctttcatctttgtgttcatctactgtaaagttgtccctctgtgtctgtgagggattggttccaggacccctgtggctaccaa

SEQ ID NO: 7431 - DNA, 201 bp, Homo sapiens
ttctgtcatctttttcaagtcttttccatccacagttggttgaatttgtggatctggaacccatggatacagagggccaactgtatttaggataatttcawcacttttaattcaaaccacaatatgtgaataagcagatagaaagaatctttttgatgtcgatgttcaactatttttggcaccatagtagaacatggttgc

SEQ ID NO: 7432 - DNA, 201 bp, Homo sapiens
ttgtataatccctaatataatgtaaatgctatttaatcgttgttatactgtattgtttttatttgtattatgttttattgtcatattgttattttctgtcmtctttttcaagtcttttccatccacagttggttgaatttgtggatctggaacccatggatacagagggccaactgtatttaggataatttcatcactttt

SEQ ID NO: 7433 - DNA, 201 bp, Homo sapiens
tctcagagtgcaagactgggaatggaaagaactacagagggacgatgtccaaaacaaaaaatggcatcacctgtcaaaaatggagttccacttctccccamagacctaggtaagacattccctttcatctttgtgttcatctactgtaaagttgtccctctgtgtctgtgagggattggttccaggacccctgtggctacc

SEQ ID NO: 7434 - DNA, 183 bp, Homo sapiens
gaatgcctagtttaaaaaaaatcaatgaaactatgagttttaggccaaatctgagaaaagatcaaagatgactatgtttgggactgaagtaagcatatcargttagaactctcatcacatgttcgactcaaattgtggagcaaaagagtaaataagatataaaaatgaaaatgaagatacgtg

SEQ ID NO: 7435 - DNA, 201 bp, Homo sapiens
agcagctgggagcaggaagtatagaagaatgtgcagcaaaatgtgaggaggacgaagaattcacctgcagggcattccaatatcacagtaaagagcaacartgtgtgataatggctgaaaacaggaagtcctccataatcattaggatgagagatgtagttttatttgaaaagaaagtgtatctctcagagtgcaagactg

SEQ ID NO: 7436 - DNA, 201 bp, Homo sapiens
gaagaatgtgcagcaaaatgtgaggaggacgaagaattcacctgcagggcattccaatatcacagtaaagagcaacaatgtgtgataatggctgaaaacargaagtcctccataatcattaggatgagagatgtagttttatttgaaaagaaagtgtatctctcagagtgcaagactgggaatggaaagaactacagaggg

SEQ ID NO: 7437 - DNA, 201 bp, Homo sapiens
gtttcttgaagacctagaacatagaagaatgcctagtttaaaaaaaatcaatgaaactatgagttttaggccaaatctgagaaaagatcaaagatgactaygtttgggactgaagtaagcatatcaagttagaactctcatcacatgttcgactcaaattgtggagcaaaagagtaaataagatataaaaatgaaaatgaa

SEQ ID NO: 7438 - DNA, 201 bp, Homo sapiens
ctgaaaacaggaagtcctccataatcattaggatgagagatgtagttttatttgaaaagaaagtgtatctctcagagtgcaagactgggaatggaaagaaytacagagggacgatgtccaaaacaaaaaatggcatcacctgtcaaaaatggagttccacttctccccacagacctaggtaagacattccctttcatcttt

SEQ ID NO: 7439 - DNA, 201 bp, Homo sapiens
aactgtatttaggataatttcatcacttttaattcaaaccacaatatgtgaataagcagatagaaagaatctttttgatgtcgatgttcaactatttttgkcaccatagtagaacatggttgctttctattttttcttggatatggaggtttcttgaagacctagaacatagaagaatgcctagtttaaaaaaaatcaatg

SEQ ID NO: 7440 - DNA, 201 bp, Homo sapiens
tctttttgatgtcgatgttcaactatttttggcaccatagtagaacatggttgctttctattttttcttggatatggaggtttcttgaagacctagaacayagaagaatgcctagtttaaaaaaaatcaatgaaactatgagttttaggccaaatctgagaaaagatcaaagatgactatgtttgggactgaagtaagcat

SEQ ID NO: 7441 - DNA, 201 bp, Homo sapiens
gtaagtcaacaacatcctgggattgggacccactttctgggcactgctggccagtcccaaaatggaacataaggaagtggttcttctacttcttttatttytgaaatcaggtcaaggagagcctctggatgactatgtgaatacccagggggcttcactgttcagtgtcactaagaagcagctgggagcaggaagtataga

SEQ ID NO: 7442 - DNA, 201 bp, Homo sapiens
agaaagaatctttttgatgtcgatgttcaactatttttggcaccatagtagaacatggttgctttctattttttcttggatatggaggtttcttgaagacytagaacatagaagaatgcctagtttaaaaaaaatcaatgaaactatgagttttaggccaaatctgagaaaagatcaaagatgactatgtttgggactgaa

SEQ ID NO: 7443 - DNA, 201 bp, Homo sapiens
atgcttctcaagtcccttatataaaatggtgcagtatttgcatataacctacataccttctcttgtataatccctaatataatgtaaatgctatttaatcrttgttatactgtattgtttttatttgtattatgttttattgtcatattgttattttctgtcatctttttcaagtcttttccatccacagttggttgaatt

SEQ ID NO: 7444 - DNA, 201 bp, Homo sapiens
tttctgaaatcaggtcaaggagagcctctggatgactatgtgaatacccagggggcttcactgttcagtgtcactaagaagcagctgggagcaggaagtakagaagaatgtgcagcaaaatgtgaggaggacgaagaattcacctgcagggcattccaatatcacagtaaagagcaacaatgtgtgataatggctgaaaac

SEQ ID NO: 7445 - DNA, 201 bp, Homo sapiens
aaatccatgcttctcaagtcccttatataaaatggtgcagtatttgcatataacctacataccttctcttgtataatccctaatataatgtaaatgctatktaatcgttgttatactgtattgtttttatttgtattatgttttattgtcatattgttattttctgtcatctttttcaagtcttttccatccacagttggt

SEQ ID NO: 7446 - DNA, 201 bp, Homo sapiens; identical to SEQ ID NO: 7419

SEQ ID NO: 7447 - DNA, 201 bp, Homo sapiens
gggacgccatgccaggactgggctgcccaggagccccatagacacagcattttcactccagagacaaatccacgggcgggtctggaaaaaaattactgccrtaaccctgatggtgatgtaggtggtccctggtgctacacgacaaatccaagaaaactttacgactactgtgatgtccctcagtgtgcggccccttcattt

SEQ ID NO: 7448 - DNA, 201 bp, Homo sapiens
ggcccacccacattcctggccctggcaagtcagtcttagaacaaggtttggaatgcacttctgtggaggcaccttgatatccccagagtgggtgttgactrctgcccactgcttggagaagtccccaaggccttcatcctacaaggtcatcctgggtgcacaccaagaagtgaatctcgaaccgcatgttcaggaaataga

SEQ ID NO: 7449 - DNA, 201 bp, Homo sapiens
agggtgacagtggagggcctctggtttgcttcgagaaggacaaatacattttacaaggagtcacttcttggggtcttggctgtgcacgccccaataagccyggtgtctatgttcgtgtttcaaggtttgttacttggattgagggagtgatgagaaataattaattggacgggagacagagtgacgcactgactcacctag

SEQ ID NO: 7450 - DNA, 201 bp, Homo sapiens
ccgaggcaagagggcgaccactgttactgggacgccatgccaggactgggctgcccaggagccccatagacacagcattttcactccagagacaaatccaygggcgggtctggaaaaaaattactgccgtaaccctgatggtgatgtaggtggtccctggtgctacacgacaaatccaagaaaactttacgactactgtga

SEQ ID NO: 7451 - DNA, 201 bp, Homo sapiens
aaaactatcgcgggaatgtggctgttaccgtgtccgggcacacctgtcagcactggagtgcacagacccctcacacacataacaggacaccagaaaacttyccctgcaaaaatttggatgaaaactactgccgcaatcctgacggaaaaagggccccatggtgccatacaaccaacagccaagtgcggtgggagtactgta

SEQ ID NO: 7452 - DNA, 201 bp, Homo sapiens
cctcatcagctaacgagggcttgacatgcatttttactgtctttattcctgacactgagatgaatgttttcaaagctgcaacatgcatggggagtcatgcraaccgattctgttattgggaatgaaatctgtcaccgactgcttgacttgagcccaggggacacagagcagagagctgtatatgatggagtgaaccggtcc

SEQ ID NO: 7453 - DNA, 201 bp, Homo sapiens
cagagtgggtgttgactgctgcccactgcttggagaagtccccaaggccttcatcctacaaggtcatcctgggtgcacaccaagaagtgaatctcgaaccrcatgttcaggaaatagaagtgtctaggctgttcttggagcccacacgaaaagatattgccttgctaaagctaagcagtcctgccgtcatcactgacaaag

SEQ ID NO: 7454 - DNA, 201 bp, Homo sapiens
ggcctgacaatgaactactgcaggaatccagatgccgataaaggcccctggtgttttaccacagaccccagcgtcaggtgggagtactgcaacctgaaaawatgctcaggaacagaagcgagtgttgtagcacctccgcctgttgtcctgcttccagatgtagagactccttccgaagaagactgtatgtttgggaatggg

SEQ ID NO: 7455 - DNA, 201 bp, Homo sapiens; identical to SEQ ID NO: 7435

SEQ ID NO: 7456 - DNA, 201 bp, Homo sapiens; identical to SEQ ID NO: 7436

SEQ ID NO: 7457 - DNA, 201 bp, Homo sapiens
taccacagaccccagcgtcaggtgggagtactgcaacctgaaaaaatgctcaggaacagaagcgagtgttgtagcacctccgcctgttgtcctgcttccaratgtagagactccttccgaagaagactgtatgtttgggaatgggaaaggataccgaggcaagagggcgaccactgttactgggacgccatgccaggactg

SEQ ID NO: 7458 - DNA, 201 bp, Homo sapiens
ctgaaaacaggaagtcctccataatcattaggatgagagatgtagttttatttgaaaagaaagtgtatctctcagagtgcaagactgggaatggaaagaaytacagagggacgatgtccaaaacaaaaaatggcatcacctgtcaaaaatggagttccacttctccccacagacctagattctcacctgctacacacccct

SEQ ID NO: 7459 - DNA, 201 bp, Homo sapiens; identical to SEQ ID NO: 7441

SEQ ID NO: 7460 - DNA, 201 bp, Homo sapiens; identical to SEQ ID NO: 7444

SEQ ID NO: 7461 - DNA, 201 bp, Homo sapiens; identical to SEQ ID NO: 7416

SEQ ID NO: 7462 - DNA, 155 bp, Homo sapiens; identical to SEQ ID NO: 7418

SEQ ID NO: 7463 - DNA, 201 bp, Homo sapiens; identical to SEQ ID NO: 7417

SEQ ID NO: 7464 - DNA, 138 bp, Homo sapiens; identical to SEQ ID NO: 7421

SEQ ID NO: 7465 - DNA, 201 bp, Homo sapiens; identical to SEQ ID NO: 7420

SEQ ID NO: 7466 - DNA, 104 bp, Homo sapiens; identical to SEQ ID NO: 7423

SEQ ID NO: 7467 - DNA, 201 bp, Homo sapiens; identical to SEQ ID NO: 7422

SEQ ID NO: 7468 - DNA, 201 bp, Homo sapiens
tgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgt

SEQ ID NO: 7469 - DNA, 201 bp, Homo sapiens
gcaatcgctatgagtttctgaatggaagagtccaatccaccgaactctgtgctgggcatttggccggaggcactgacagttgccagggtgacagtggaggkcctctggtttgcttcgagaaggacaaatacattttacaaggagtcacttcttggggtcttggctgtgcacgccccaataagcctggtgtctatgttcgtg

SEQ ID NO: 7470 - DNA, 201 bp, Homo sapiens
gtgtgtggcccacccacattcctggccctggcaagtcagtcttagaacaaggtttggaatgcacttctgtggaggcaccttgatatccccagagtgggtgytgactgctgcccactgcttggagaagtccccaaggccttcatcctacaaggtcatcctgggtgcacaccaagaagtgaatctcgaaccgcatgttcagga

SEQ ID NO: 7471 - DNA, 201 bp, Homo sapiens
tcaggtgggagtactgcaacctgaaaaaatgctcaggaacagaagcgagtgttgtagcacctccgcctgttgtcctgcttccagatgtagagactccttcygaagaagactgtatgtttgggaatgggaaaggataccgaggcaagagggcgaccactgttactgggacgccatgccaggactgggctgcccaggagcccc

SEQ ID NO: 7472 - DNA, 201 bp, Homo sapiens; identical to SEQ ID NO: 7427

SEQ ID NO: 7473 - DNA, 201 bp, Homo sapiens
ctctcagagtgcaagactgggaatggaaagaactacagagggacgatgtccaaaacaaaaaatggcatcacctgtcaaaaatggagttccacttctccccrcagacctagattctcacctgctacacacccctcagagggactggaggagaactactgcaggaatccagacaacgatccgcaggggccctggtgctatact

SEQ ID NO: 7474 - DNA, 201 bp, Homo sapiens
aaaatggcatcacctgtcaaaaatggagttccacttctccccacagacctagattctcacctgctacacacccctcagagggactggaggagaactactgmaggaatccagacaacgatccgcaggggccctggtgctatactactgatccagaaaagagatatgactactgcgacattcttgagtgtgaagaggaatgta

SEQ ID NO: 7475 - DNA, 201 bp, Homo sapiens
tcagagtgcaagactgggaatggaaagaactacagagggacgatgtccaaaacaaaaaatggcatcacctgtcaaaaatggagttccacttctccccacaracctagattctcacctgctacacacccctcagagggactggaggagaactactgcaggaatccagacaacgatccgcaggggccctggtgctatactact

SEQ ID NO: 7476 - DNA, 201 bp, Homo sapiens
gcccacacgaaaagatattgccttgctaaagctaagcagtcctgccgtcatcactgacaaagtaatcccagcttgtctgccatccccaaattatgtggtcrctgaccggaccgaatgtttcatcactggctggggagaaacccaaggtacttttggagctggccttctcaaggaagcccagctccctgtgattgagaataa

SEQ ID NO: 7477 - DNA, 201 bp, Homo sapiens
ttccaaacaagaacctgaagaagaattactgtcgtaaccccgatagggagctgcggccttggtgtttcaccaccgaccccaacaagcgctgggaactttgygacatcccccgctgcacaacacctccaccatcttctggtcccacctaccagtgtctgaagggaacaggtgaaaactatcgcgggaatgtggctgttaccg

SEQ ID NO: 7478 - DNA, 201 bp, Homo sapiens
aacctgaagaagaattactgtcgtaaccccgatagggagctgcggccttggtgtttcaccaccgaccccaacaagcgctgggaactttgtgacatcccccrctgcacaacacctccaccatcttctggtcccacctaccagtgtctgaagggaacaggtgaaaactatcgcgggaatgtggctgttaccgtgtccgggcac

SEQ ID NO: 7479 - DNA, 201 bp, Homo sapiens
tctcagagtgcaagactgggaatggaaagaactacagagggacgatgtccaaaacaaaaaatggcatcacctgtcaaaaatggagttccacttctccccamagacctagattctcacctgctacacacccctcagagggactggaggagaactactgcaggaatccagacaacgatccgcaggggccctggtgctatacta

SEQ ID NO: 7480 - DNA, 201 bp, Homo sapiens
acggaaaaagggccccatggtgccatacaaccaacagccaagtgcggtgggagtactgtaagataccgtcctgtgactcctccccagtatccacggaacarttggctcccacagcaccacctgagctaacccctgtggtccaggactgctaccatggtgatggacagagctaccgaggcacatcctccaccaccaccacag

SEQ ID NO: 7481 - DNA, 201 bp, Homo sapiens
ccacacgaaaagatattgccttgctaaagctaagcagtcctgccgtcatcactgacaaagtaatcccagcttgtctgccatccccaaattatgtggtcgcygaccggaccgaatgtttcatcactggctggggagaaacccaaggtacttttggagctggccttctcaaggaagcccagctccctgtgattgagaataaag

SEQ ID NO: 7482 - DNA, 201 bp, Homo sapiens
ttgtccacgcatttacctcatcagctaacgagggcttgacatgcatttttactgtctttattcctgacactgagatgaatgttttcaaagctgcaacatgyatggggagtcatgcgaaccgattctgttattgggaatgaaatctgtcaccgactgcttgacttgagcccaggggacacagagcagagagctgtatatgat

SEQ ID NO: 7483 - DNA, 201 bp, Homo sapiens
atgttcgtgtttcaaggtttgttacttggattgagggagtgatgagaaataattaattggacgggagacagagtgacgcactgactcacctagaggctggracgtgggtagggatttagcatgctggaaataactggcagtaatcaaacgaagacactgtccccagctaccagctacgccaaacctcggcattttttgtgt

SEQ ID NO: 7484 - DNA, 201 bp, Homo sapiens
agctccctgtgattgagaataaagtgtgcaatcgctatgagtttctgaatggaagagtccaatccaccgaactctgtgctgggcatttggccggaggcacygacagttgccagggtgacagtggagggcctctggtttgcttcgagaaggacaaatacattttacaaggagtcacttcttggggtcttggctgtgcacgcc

SEQ ID NO: 7485 - DNA, 201 bp, Homo sapiens
atgcgaaccgattctgttattgggaatgaaatctgtcaccgactgcttgacttgagcccaggggacacagagcagagagctgtatatgatggagtgaacckgtccatggatgtgtaacacaagaccaactgagagtctgaatgttattctggggcacacgtgagtctaggattggtgccaagagcatgtaaatgaacaaca

SEQ ID NO: 7486 - DNA, 201 bp, Homo sapiens
tgttttcaaagctgcaacatgcatggggagtcatgcgaaccgattctgttattgggaatgaaatctgtcaccgactgcttgacttgagcccaggggacacrgagcagagagctgtatatgatggagtgaaccggtccatggatgtgtaacacaagaccaactgagagtctgaatgttattctggggcacacgtgagtctag

SEQ ID NO: 7487 - DNA, 201 bp, Homo sapiens
gttgtagcacctccgcctgttgtcctgcttccagatgtagagactccttccgaagaagactgtatgtttgggaatgggaaaggataccgaggcaagagggygaccactgttactgggacgccatgccaggactgggctgcccaggagccccatagacacagcattttcactccagagacaaatccacgggcgggtctggaa

SEQ ID NO: 7488 - DNA, 201 bp, Homo sapiens
ccaggactgctaccatggtgatggacagagctaccgaggcacatcctccaccaccaccacaggaaagaagtgtcagtcttggtcatctatgacaccacacyggcaccagaagaccccagaaaactacccaaatgctggcctgacaatgaactactgcaggaatccagatgccgataaaggcccctggtgttttaccacaga

SEQ ID NO: 7489 - DNA, 201 bp, Homo sapiens
ctcacctgctacacacccctcagagggactggaggagaactactgcaggaatccagacaacgatccgcaggggccctggtgctatactactgatccagaasagagatatgactactgcgacattcttgagtgtgaagaggaatgtatgcattgcagtggagaaaactatgacggcaaaatttccaagaccatgtctggact

SEQ ID NO: 7490 - DNA, 201 bp, Homo sapiens
atacctactaaataggtcaaggagagcctctggatgactatgtgaatacccagggggcttcactgttcagtgtcactaagaagcagctgggagcaggaagyatagaagaatgtgcagcaaaatgtgaggaggacgaagaattcacctgcagggcattccaatatcacagtaaagagcaacaatgtgtgataatggctgaaa

SEQ ID NO: 7491 - DNA, 176 bp, Homo sapiens
cacccaggtagtgagctaaatacctactaaataggtcaaggagagcctctggatgactatgtgaatacccaggggscttcactgttcagtgtcactaagaagcagctgggagcaggaagtatagaagaatgtgcagcaaaatgtgaggaggacgaagaattcacctgcagggcatt

SEQ ID NO: 7492 - DNA, 201 bp, Homo sapiens; identical to SEQ ID NO: 7419

SEQ ID NO: 7493 - DNA, 167 bp, Homo sapiens
cacccaggtagtgagctaaatacctactaaataggtcaaggagagcctctggatgactatgtgaatrcccagggggcttcactgttcagtgtcactaagaagcagctgggagcaggaagtatagaagaatgtgcagcaaaatgtgaggaggacgaagaattcacctg

SEQ ID NO: 7494 - DNA, 163 bp, Homo sapiens
cacccaggtagtgagctaaatacctactaaataggtcaaggagagcctctggatgactatgtraatacccagggggcttcactgttcagtgtcactaagaagcagctgggagcaggaagtatagaagaatgtgcagcaaaatgtgaggaggacgaagaattca

SEQ ID NO: 7495 - DNA, 115 bp, Homo sapiens; identical to SEQ ID NO: 7424

SEQ ID NO: 7496 - DNA, 201 bp, Homo sapiens; identical to SEQ ID NO: 7425

SEQ ID NO: 7497 - DNA, 201 bp, Homo sapiens; identical to SEQ ID NO: 7426

SEQ ID NO: 7498 - DNA, 201 bp, Homo sapiens; identical to SEQ ID NO: 7427

SEQ ID NO: 7499 - DNA, 201 bp, Homo sapiens; identical to SEQ ID NO: 7428

SEQ ID NO: 7500 - DNA, 201 bp, Homo sapiens; identical to SEQ ID NO: 7429

SEQ ID NO: 7501 - DNA, 201 bp, Homo sapiens; identical to SEQ ID NO: 7430

SEQ ID NO: 7502 - DNA, 201 bp, Homo sapiens; identical to SEQ ID NO: 7431

SEQ ID NO: 7503 - DNA, 201 bp, Homo sapiens; identical to SEQ ID NO: 7432

SEQ ID NO: 7504 - DNA, 201 bp, Homo sapiens; identical to SEQ ID NO: 7433

SEQ ID NO: 7505 - DNA, 183 bp, Homo sapiens; identical to SEQ ID NO: 7434

SEQ ID NO: 7506 - DNA, 201 bp, Homo sapiens; identical to SEQ ID NO: 7437

SEQ ID NO: 7507 - DNA, 201 bp, Homo sapiens; identical to SEQ ID NO: 7436

SEQ ID NO: 7508 - DNA, 201 bp, Homo sapiens; identical to SEQ ID NO: 7435

SEQ ID NO: 7509 - DNA, 201 bp, Homo sapiens; identical to SEQ ID NO: 7439

SEQ ID NO: 7510 - DNA, 201 bp, Homo sapiens; identical to SEQ ID NO: 7438

SEQ ID NO: 7511 - DNA, 201 bp, Homo sapiens; identical to SEQ ID NO: 7440

SEQ ID NO: 7512 - DNA, 201 bp, Homo sapiens; identical to SEQ ID NO: 7442

SEQ ID NO: 7513 - DNA, 201 bp, Homo sapiens; identical to SEQ ID NO: 7443

SEQ ID NO: 7514 - DNA, 201 bp, Homo sapiens
acctactaaataggtcaaggagagcctctggatgactatgtgaatacccagggggcttcactgttcagtgtcactaagaagcagctgggagcaggaagtakagaagaatgtgcagcaaaatgtgaggaggacgaagaattcacctgcagggcattccaatatcacagtaaagagcaacaatgtgtgataatggctgaaaac

SEQ ID NO: 7515 - DNA, 201 bp, Homo sapiens; identical to SEQ ID NO: 7445

SEQ ID NO: 7516 - DNA, 201 bp, Homo sapiens; identical to SEQ ID NO: 7416

SEQ ID NO: 7517 - DNA, 201 bp, Homo sapiens
attttcttcctcctcctcctactgtcctccccatcctcccactcttcctctttctctattctatctttaatttataagaccagaggaggaaggcactatcrtgttataaaactgaattctgagttaggacaggatttgattactaactaaccatgtcagcttgagtgtattacttcacctcttagatttaattttttttgt

SEQ ID NO: 7518 - DNA, 201 bp, Homo sapiens
acattttcttcctcctcctcctactgtcctccccatcctcccactcttcctctttctctattctatctttaatttataagaccagaggaggaaggcactaycatgttataaaactgaattctgagttaggacaggatttgattactaactaaccatgtcagcttgagtgtattacttcacctcttagatttaatttttttt

SEQ ID NO: 7519 - DNA, 201 bp, Homo sapiens; identical to SEQ ID NO: 7417

SEQ ID NO: 7520 - DNA, 155 bp, Homo sapiens; identical to SEQ ID NO: 7418

SEQ ID NO: 7521 - DNA, 201 bp, Homo sapiens
gaattcacctgcagggcattccaatatcacagtaaagagcaacaatgtgtgataatggctgaaaacaggaagtcctccataatcattaggatgagagatgyagttttatttgaaaagaaaggtgagtacattttcttcctcctcctcctactgtcctccccatcctcccactcttcctctttctctattctatctttaatt

SEQ ID NO: 7522 - DNA, 201 bp, Homo sapiens; identical to SEQ ID NO: 7420

SEQ ID NO: 7523 - DNA, 138 bp, Homo sapiens; identical to SEQ ID NO: 7421

SEQ ID NO: 7524 - DNA, 201 bp, Homo sapiens; identical to SEQ ID NO: 7422

SEQ ID NO: 7525 - DNA, 104 bp, Homo sapiens; identical to SEQ ID NO: 7423

SEQ ID NO: 7526 - DNA, 201 bp, Homo sapiens
tttatttgaaaagaaaggtgagtacattttcttcctcctcctcctactgtcctccccatcctcccactcttcctctttctctattctatctttaatttatragaccagaggaggaaggcactatcatgttataaaactgaattctgagttaggacaggatttgattactaactaaccatgtcagcttgagtgtattacttc

SEQ ID NO: 7527 - DNA, 201 bp, Homo sapiens
aagtcctccataatcattaggatgagagatgtagttttatttgaaaagaaaggtgagtacattttcttcctcctcctcctactgtcctccccatcctcccrctcttcctctttctctattctatctttaatttataagaccagaggaggaaggcactatcatgttataaaactgaattctgagttaggacaggatttgatt

SEQ ID NO: 7528 - DNA, 201 bp, Homo sapiens
tgagtacattttcttcctcctcctcctactgtcctccccatcctcccactcttcctctttctctattctatctttaatttataagaccagaggaggaaggyactatcatgttataaaactgaattctgagttaggacaggatttgattactaactaaccatgtcagcttgagtgtattacttcacctcttagatttaattt

SEQ ID NO: 7529 - DNA, 201 bp, Homo sapiens
gaagaatgtgcagcaaaatgtgaggaggacgaagaattcacctgcagggcattccaatatcacagtaaagagcaacaatgtgtgataatggctgaaaacargaagtcctccataatcattaggatgagagatgtagttttatttgaaaagaaaggtgagtacattttcttcctcctcctcctactgtcctccccatcctcc

SEQ ID NO: 7530 - DNA, 201 bp, Homo sapiens
agcagctgggagcaggaagtatagaagaatgtgcagcaaaatgtgaggaggacgaagaattcacctgcagggcattccaatatcacagtaaagagcaacartgtgtgataatggctgaaaacaggaagtcctccataatcattaggatgagagatgtagttttatttgaaaagaaaggtgagtacattttcttcctcctcc

SEQ ID NO: 7531 - DNA, 201 bp, Homo sapiens; identical to SEQ ID NO: 7441

SEQ ID NO: 7532 - DNA, 201 bp, Homo sapiens; identical to SEQ ID NO: 7444

SEQ ID NO: 7533 - DNA, 201 bp, Homo sapiens; identical to SEQ ID NO: 7416

SEQ ID NO: 7534 - DNA, 155 bp, Homo sapiens; identical to SEQ ID NO: 7418

SEQ ID NO: 7535 - DNA, 201 bp, Homo sapiens; identical to SEQ ID NO: 7417

SEQ ID NO: 7536 - DNA, 138 bp, Homo sapiens; identical to SEQ ID NO: 7421

SEQ ID NO: 7537 - DNA, 201 bp, Homo sapiens; identical to SEQ ID NO: 7420

SEQ ID NO: 7538 - DNA, 201 bp, Homo sapiens; identical to SEQ ID NO: 7419

SEQ ID NO: 7539 - DNA, 104 bp, Homo sapiens; identical to SEQ ID NO: 7423

SEQ ID NO: 7540 - DNA, 201 bp, Homo sapiens; identical to SEQ ID NO: 7422

SEQ ID NO: 7541 - DNA, 201 bp, Homo sapiens
gggacgccatgccaggactgggctgcccaggagccccatagacacagcattttcactccagagacaaatccacgggcgggtctggaaaaaaattactgccrtaaccctgatggtgatgtaggtggtccctggtgctacacgacaaatccaagaaaactttacgactactgtgatgtccctcagtgtggtaggttgccttct

SEQ ID NO: 7542 - DNA, 201 bp, Homo sapiens; identical to SEQ ID NO: 7471

SEQ ID NO: 7543 - DNA, 201 bp, Homo sapiens; identical to SEQ ID NO: 7427

SEQ ID NO: 7544 - DNA, 201 bp, Homo sapiens; identical to SEQ ID NO: 7473

SEQ ID NO: 7545 - DNA, 201 bp, Homo sapiens; identical to SEQ ID NO: 7474

SEQ ID NO: 7546 - DNA, 201 bp, Homo sapiens; identical to SEQ ID NO: 7475

SEQ ID NO: 7547 - DNA, 201 bp, Homo sapiens; identical to SEQ ID NO: 7450

SEQ ID NO: 7548 - DNA, 201 bp, Homo sapiens
acagctgagaagtaagaaagaaaatacaaacagcaggaaacaggtaagcatgtaacgcacattgtaaacctcagatggccatcctaggaattcaatgaaargtagtgcagctctttagccccagatggcctttcttataagtttactactcacaagtcacattagtgacatagcttagagactgcttgttgggttccatcc

SEQ ID NO: 7549 - DNA, 201 bp, Homo sapiens; identical to SEQ ID NO: 7451

SEQ ID NO: 7550 - DNA, 201 bp, Homo sapiens; identical to SEQ ID NO: 7477

SEQ ID NO: 7551 - DNA, 201 bp, Homo sapiens; identical to SEQ ID NO: 7478

SEQ ID NO: 7552 - DNA, 201 bp, Homo sapiens; identical to SEQ ID NO: 7479

SEQ ID NO: 7553 - DNA, 201 bp, Homo sapiens; identical to SEQ ID NO: 7480

SEQ ID NO: 7554 - DNA, 201 bp, Homo sapiens; identical to SEQ ID NO: 7436

SEQ ID NO: 7555 - DNA, 201 bp, Homo sapiens; identical to SEQ ID NO: 7454

SEQ ID NO: 7556 - DNA, 201 bp, Homo sapiens; identical to SEQ ID NO: 7435

SEQ ID NO: 7557 - DNA, 201 bp, Homo sapiens; identical to SEQ ID NO: 7457

SEQ ID NO: 7558 - DNA, 201 bp, Homo sapiens; identical to SEQ ID NO: 7458

SEQ ID NO: 7559 - DNA, 201 bp, Homo sapiens
acaaatccaagaaaactttacgactactgtgatgtccctcagtgtggtaggttgccttctttttggtaaggaaactgcttacttaatatggatttgcaacmaaaaaggaaaagggcttctgagcagactgcttctggggaggagatagctgccctctccatcagaccccactcttcatcatgggcatcttgaatctgccct

SEQ ID NO: 7560 - DNA, 201 bp, Homo sapiens; identical to SEQ ID NO: 7487

SEQ ID NO: 7561 - DNA, 201 bp, Homo sapiens; identical to SEQ ID NO: 7488

SEQ ID NO: 7562 - DNA, 201 bp, Homo sapiens; identical to SEQ ID NO: 7441

SEQ ID NO: 7563 - DNA, 201 bp, Homo sapiens; identical to SEQ ID NO: 7489

SEQ ID NO: 7564 - DNA, 201 bp, Homo sapiens; identical to SEQ ID NO: 7444

SEQ ID NO: 7565 - DNA, 201 bp, Homo sapiens
aacatggaagttatgaagatgctgttcactctggagcccttaatgattgatctgatgttccttttatttataacaatgttaaatgcaattgtcttgtaccktgagttgagtattacacattaaagtaaagtacaagctgtaaacttgggtttttgtgatgtaggaaatggtttccatctgtactttggtcctctgatttca

SEQ ID NO: 7566 - DNA, 201 bp, Homo sapiens
ttcccataatggaaggctccacacccacttgggaccaggaaactatccgtgctaaaggtgtaagcccacgtttatcagcttctgacttcttcataagaacracagctgcagcaccatcatttattcctgaagcattggctggggtgactgttcccgttccatcagtaagaaagtaaggctttagcttggacatggcttcta

SEQ ID NO: 7567 - DNA, 201 bp, Homo sapiens
aaagaaattgaggttgttcaaagtttaagcaattcattctctctgaacacacattgctattcccatcccacccccaatgcacagggctgcaacaccacgayttctgcccattctctccagtgtgtgtaacagggtcacaagaattcgacagccagatgctccaagagggtggcccaaggctatagcccctccttcaatatt

SEQ ID NO: 7568 - DNA, 201 bp, Homo sapiens
aaggctatagcccctccttcaatattgacggtcctattcccataatggaaggctccacacccacttgggaccaggaaactatccgtgctaaaggtgtaagyccacgtttatcagcttctgacttcttcataagaacgacagctgcagcaccatcatttattcctgaagcattggctggggtgactgttcccgttccatcag

SEQ ID NO: 7569 - DNA, 201 bp, Homo sapiens
aatcaccattcttcgaattgatgatcttattaaattacatccagaaagtaaagatgataaacatggaagttatgaagatgctgttcactctggagcccttwatgattgatctgatgttccttttatttataacaatgttaaatgcaattgtcttgtaccttgagttgagtattacacattaaagtaaagtacaagctgtaa

SEQ ID NO: 7570 - DNA, 201 bp, Homo sapiens
tcccgttccatcagtaagaaagtaaggctttagcttggacatggcttctatgttgctcccatggcgaggaaactcatctgttttaacttcaataagacctyttctagttgacaccaaaactggtacaatctctttgtcaaaatggccagctttctgtgcattctctgtcctgttctgggacagaactgcaaccttgtcctg

SEQ ID NO: 7571 - DNA, 201 bp, Homo sapiens
tttgagcaatggtaaacctcgagacaacaaacaagcaggggtgtttgaaccaaccatagttaaagttaagagtttgaaatttgcaacagaagctgcaatcmccattcttcgaattgatgatcttattaaattacatccagaaagtaaagatgataaacatggaagttatgaagatgctgttcactctggagcccttaatga

SEQ ID NO: 7572 - DNA, 201 bp, Homo sapiens
atcaccattcttcgaattgatgatcttattaaattacatccagaaagtaaagatgataaacatggaagttatgaagatgctgttcactctggagcccttawtgattgatctgatgttccttttatttataacaatgttaaatgcaattgtcttgtaccttgagttgagtattacacattaaagtaaagtacaagctgtaaa

SEQ ID NO: 7573 - DNA, 201 bp, Homo sapiens
ccagaaagtaaagatgataaacatggaagttatgaagatgctgttcactctggagcccttaatgattgatctgatgttccttttatttataacaatgttaratgcaattgtcttgtaccttgagttgagtattacacattaaagtaaagtacaagctgtaaacttgggtttttgtgatgtaggaaatggtttccatctgta

SEQ ID NO: 7574 - DNA, 201 bp, Homo sapiens
cagccgggaagcgggtggggtggtgtgttacccagtagctcctgggacatcgctcgggtacgctccacgccgtcgcagccactgctgtggtcgccggtcgsccgaggggccgcgatactggttgcccgcggtgtaagcagaattcgacgtgtatcgctgccgtcaagatggaggggcctttgtccgtgttcggtgaccgca

SEQ ID NO: 7575 - DNA, 201 bp, Homo sapiens
ccttcccgccgtgccccgcggccgggccggggcagccgggaagcgggtggggtggtgtgttacccagtagctcctgggacatcgctcgggtacgctccacrccgtcgcagccactgctgtggtcgccggtcggccgaggggccgcgatactggttgcccgcggtgtaagcagaattcgacgtgtatcgctgccgtcaagat

SEQ ID NO: 7576 - DNA, 201 bp, Homo sapiens; identical to SEQ ID NO: 7565

SEQ ID NO: 7577 - DNA, 201 bp, Homo sapiens
ccattctctccagtgtgtgtaacagggtcacaagaattcgacagccagatgctccaagagggtggcccaaggctatagcccctccttcaatattgacctarcgggggagaaaagatttagattgtttattcttctgtggacacagtttaaaatcttaaacttgtctttttcctcttaatgtatcagcatgctaccctttca

SEQ ID NO: 7578 - DNA, 192 bp, Homo sapiens
cctgttgtccctgcctctttttccttcccgccgtgccccgcggccgggccggggcagccgggaagcgggtggggtggtgtgttacccagtakctcctgggacatcgctcgggtacgctccacgccgtcgcagccactgctgtggtcgccggtcggccgaggggccgcgatactggttgcccgcggtgtaagc

SEQ ID NO: 7579 - DNA, 201 bp, Homo sapiens; identical to SEQ ID NO: 7567

SEQ ID NO: 7580 - DNA, 201 bp, Homo sapiens; identical to SEQ ID NO: 7569

SEQ ID NO: 7581 - DNA, 201 bp, Homo sapiens; identical to SEQ ID NO: 7572

SEQ ID NO: 7582 - DNA, 201 bp, Homo sapiens; identical to SEQ ID NO: 7571

SEQ ID NO: 7583 - DNA, 201 bp, Homo sapiens; identical to SEQ ID NO: 7573

SEQ ID NO: 7584 - DNA, 201 bp, Homo sapiens
cttcccgccgtgccccgcggccgggccggggcagccgggaagcgggtggggtggtgtgttacccagtagctcctgggacatcgctcgggtacgctccacgycgtcgcagccactgctgtggtcgccggtcggccgaggggccgcgatactggttgcccgcggtgtaagcagaattcgacgtgtatcgctgccgtcaagatg

SEQ ID NO: 7585 - DNA, 201 bp, Homo sapiens; identical to SEQ ID NO: 7574

SEQ ID NO: 7586 - DNA, 201 bp, Homo sapiens; identical to SEQ ID NO: 7575

SEQ ID NO: 7587 - DNA, 201 bp, Homo sapiens; identical to SEQ ID NO: 7565

SEQ ID NO: 7588 - DNA, 192 bp, Homo sapiens; identical to SEQ ID NO: 7578

SEQ ID NO: 7589 - DNA, 201 bp, Homo sapiens; identical to SEQ ID NO: 7566

SEQ ID NO: 7590 - DNA, 201 bp, Homo sapiens; identical to SEQ ID NO: 7567

SEQ ID NO: 7591 - DNA, 201 bp, Homo sapiens; identical to SEQ ID NO: 7568

SEQ ID NO: 7592 - DNA, 201 bp, Homo sapiens; identical to SEQ ID NO: 7569

SEQ ID NO: 7593 - DNA, 201 bp, Homo sapiens; identical to SEQ ID NO: 7571

SEQ ID NO: 7594 - DNA, 201 bp, Homo sapiens; identical to SEQ ID NO: 7572

SEQ ID NO: 7595 - DNA, 201 bp, Homo sapiens; identical to SEQ ID NO: 7570

SEQ ID NO: 7596 - DNA, 201 bp, Homo sapiens; identical to SEQ ID NO: 7573

SEQ ID NO: 7597 - DNA, 201 bp, Homo sapiens; identical to SEQ ID NO: 7584

SEQ ID NO: 7598 - DNA, 193 bp, Homo sapiens
gcaaagctcctcctcgcagcccacaggcctgccgcgggcgggacctgagctcaggactggaatcccacgggcgagaatctcgagtgcgagcccggcccgcrgcgggtctcagcacagctctgatgggtccttttgctctcggcggcttcgggaggtcctatgcgtttctcctggcgccagtcattcgctcgcg

SEQ ID NO: 7599 - DNA, 201 bp, Homo sapiens
ctaacttatgaaaatggcttgttaaaaatgaacttcacggggggggacacttgccataaggtttatcagcgctccacagccatcttcttctactgtgaccrcggcacccagcggccagtatttctaaaggagacttcagattgttcctacttgtttgagtggcgaacgcagtatgcctgcccacctttcgatctgactgaa

SEQ ID NO: 7600 - DNA, 201 bp, Homo sapiens
tgtcaggaaaagcgggaaccgcagggatttcacaaagtggcaggtctcctgactcagaagctaacttatgaaaatggcttgttaaaaatgaacttcacggrgggggacacttgccataaggtttatcagcgctccacagccatcttcttctactgtgaccgcggcacccagcggccagtatttctaaaggagacttcagat

SEQ ID NO: 7601 - DNA, 201 bp, Homo sapiens
gcaccaagggggcatcctttggacggctgcaatcaatgaaactggattacaggcaccaggatgaagcggtcgttttaagttacgtgaatggtgatcgttgycctccagaaaccgatgacggcgtcccctgtgtcttccccttcatattcaatgggaagagctacgaggagtgcatcatagagagcagggcgaagctgtggt

SEQ ID NO: 7602 - DNA, 201 bp, Homo sapiens
cttgggtctgagtaatgcgaagctttcatattatgatgggatgatccaactgaactacagaggcggcacaccctataacaatgaaagacacacaccgagarctacgctcatcacctttctctgtgatcgagacgcgggagtgggcttccctgaatatcaggaagaggataactccacctacaacttccggtggtacaccag

SEQ ID NO: 7603 - DNA, 201 bp, Homo sapiens
gtgactcgcgactcgcgcacctacagcgttggggtgtgcacctttgcagtcgggccagaacaaggaggctgtaaggacggaggagtctgtctgctctcagrcaccaagggggcatcctttggacggctgcaatcaatgaaactggattacaggcaccaggatgaagcggtcgttttaagttacgtgaatggtgatcgttgc

SEQ ID NO: 7604 - DNA, 201 bp, Homo sapiens
cgacgggaagaagcgctatgacctgtccgcgctggtccgccatgcagaaccagagcagaattgggaagctgtggatggcagtcagacggaaacagagaagmagcattttttcattaatatttgtcacagagtgctgcaggaaggcaaggcacgagggtgtcccgaggacgcggcagtgtgtgcagtggataaaaatggaag

SEQ ID NO: 7605 - DNA, 201 bp, Homo sapiens
gtgaggatggatggctgtaccctgacagatgagcagctcctctacagcttcaacttgtccagcctttccacgagcacctttaaggtgactcgcgactcgcrcacctacagcgttggggtgtgcacctttgcagtcgggccagaacaaggaggctgtaaggacggaggagtctgtctgctctcaggcaccaagggggcatcc

SEQ ID NO: 7606 - DNA, 201 bp, Homo sapiens
aaggaggtgccatgctatgtgtttgatgaagagttgaggaagcatgatctcaatcctctgatcaagcttagtggtgcctacttggtggatgactccgatcyggacacttctctattcatcaatgtttgtagagacatagacacactacgagacccaggttcacagctgcgggcctgtccccccggcactgccgcctgcctg

SEQ ID NO: 7607 - DNA, 201 bp, Homo sapiens
ctgagtatgcctgccacagagattacctggaaagtaaaacttgttctctgagcggcgagcagcaggatgtctccatagacctcacaccacttgcccagagyggaggttcatcctatatttcagatggaaaagaatatttgttttatttgaatgtctgtggagaaactgaaatacagttctgtaataaaaaacaagctgcag

SEQ ID NO: 7608 - DNA, 201 bp, Homo sapiens
aggtggcaaaaagtgatgagaagacttggaacttgggtctgagtaatgcgaagctttcatattatgatgggatgatccaactgaactacagaggcggcacrccctataacaatgaaagacacacaccgagagctacgctcatcacctttctctgtgatcgagacgcgggagtgggcttccctgaatatcaggaagaggata

SEQ ID NO: 7609 - DNA, 201 bp, Homo sapiens
cttgccagatgaagtatgaaaaagatcagggctccttcactgaagtggtttccatcagtaacttgggaatggcaaagaccggcccggtggttgaggacagyggcagcctccttctggaatacgtgaatgggtcggcctgcaccaccagcgatggcagacagaccacatataccacgaggatccatctcgtctgctccaggg

SEQ ID NO: 7610 - DNA, 201 bp, Homo sapiens
taattgtcctgaaatacgttgatggcgacttatgtccagatgggattcggaaaaagtcaaccaccatccgattcacctgcagcgagagccaagtgaactcyaggcccatgttcatcagcgccgtggaggactgtgagtacacctttgcctggcccacagccacagcctgtcccatgaagagcaacgagcatgatgactgcc

SEQ ID NO: 7611 - DNA, 201 bp, Homo sapiens
ctgcaaccgatatgcatcggcttgccagatgaagtatgaaaaagatcagggctccttcactgaagtggtttccatcagtaacttgggaatggcaaagaccrgcccggtggttgaggacagcggcagcctccttctggaatacgtgaatgggtcggcctgcaccaccagcgatggcagacagaccacatataccacgaggat

SEQ ID NO: 7612 - DNA, 201 bp, Homo sapiens
gaattggaagccagcaaggccagtcggaattgagaaaagcctccagctgtccacagagggcttcatcactctgacctacaaagggcctctctctgccaaasgtaccgctgatgcttttatcgtccgctttgtttgcaatgatgatgtttactcagggcccctcaaattcctgcatcaagatatcgactctgggcaagggat

SEQ ID NO: 7613 - DNA, 201 bp, Homo sapiens
tcacacttgtatgcaagccaggtgatctggaaagtgcaccagtgttgagaacttctggggaaggcggttgcttttatgagtttgagtggcacacagctgcrgcctgtgtgctgtctaagacagaaggggagaactgcacggtctttgactcccaggcagggttttcttttgacttatcacctctcacaaagaaaaatggtg

SEQ ID NO: 7614 - DNA, 201 bp, Homo sapiens
tgattgtggtcatggcaagaaaattaaaactaatatcacacttgtatgcaagccaggtgatctggaaagtgcaccagtgttgagaacttctggggaaggcrgttgcttttatgagtttgagtggcacacagctgcggcctgtgtgctgtctaagacagaaggggagaactgcacggtctttgactcccaggcagggttttc

SEQ ID NO: 7615 - DNA, 201 bp, Homo sapiens
cggcgtgctctggagccaacatatgccaggtgaagcccaacgatcagcacttcagtcggaaagttggaacctctgacaagaccaagtactaccttcaagayggcgatctcgatgtcgtgtttgcctcttcctctaagtgcggaaaggataagaccaagtctgtttcttccaccatcttcttccactgtgaccctctggtgg

SEQ ID NO: 7616 - DNA, 201 bp, Homo sapiens
caaataaggaggtgccatgctatgtgtttgatgaagagttgaggaagcatgatctcaatcctctgatcaagcttagtggtgcctacttggtggatgactcygatccggacacttctctattcatcaatgtttgtagagacatagacacactacgagacccaggttcacagctgcgggcctgtccccccggcactgccgcct

SEQ ID NO: 7617 - DNA, 201 bp, Homo sapiens
ccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcgaccgaatg

SEQ ID NO: 7618 - DNA, 201 bp, Homo sapiens
acgagacccaggttcacagctgcgggcctgtccccccggcactgccgcctgcctggtaagaggacaccaggcgtttgatgttggccagccccgggacggastgaagctggtgcgcaaggacaggcttgtcctgagttacgtgagggaagaggcaggaaagctagacttttgtgatggtcacagccctgcggtgactattac

SEQ ID NO: 7619 - DNA, 201 bp, Homo sapiens
ctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagat

SEQ ID NO: 7620 - DNA, 201 bp, Homo sapiens
cctgccacagagattacctggaaagtaaaacttgttctctgagcggcgagcagcaggatgtctccatagacctcacaccacttgcccagagcggaggttcrtcctatatttcagatggaaaagaatatttgttttatttgaatgtctgtggagaaactgaaatacagttctgtaataaaaaacaagctgcagtttgccaag

SEQ ID NO: 7621 - DNA, 201 bp, Homo sapiens
aagttgtctgccctccaaagaagttggagtgcaaattcgtccagaaacacaaaacctacgacctgcggctgctctcctctctcaccgggtcctggtccctsgtccacaacggagtctcgtactatataaatctgtgccagaaaatatataaagggcccctgggctgctctgaaagggccagcatttgcagaaggaccacaa

SEQ ID NO: 7622 - DNA, 201 bp, Homo sapiens
gagcagaattgggaagctgtggatggcagtcagacggaaacagagaagaagcattttttcattaatatttgtcacagagtgctgcaggaaggcaaggcacragggtgtcccgaggacgcggcagtgtgtgcagtggataaaaatggaagtaaaaatctgggaaaatttatttcctctcccatgaaagagaaaggaaacatt

SEQ ID NO: 7623 - DNA, 201 bp, Homo sapiens
accaaaaataatgtactttataaaatcaacatctgtggaagtgtggatattgtccagtgcgggccatcaagtgctgtttgtatgcacgacttgaagacacrcacttatcattcagtgggtgactctgttttgagaagtgcaaccagatctctcctggaattcaacacaacagtgagctgtgaccagcaaggcacaaatcac

SEQ ID NO: 7624 - DNA, 201 bp, Homo sapiens
cctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccaga

SEQ ID NO: 7625 - DNA, 201 bp, Homo sapiens
gcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccag

SEQ ID NO: 7626 - DNA, 201 bp, Homo sapiens
atgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttcc

SEQ ID NO: 7627 - DNA, 201 bp, Homo sapiens
attacaggcaccaggatgaagcggtcgttttaagttacgtgaatggtgatcgttgccctccagaaaccgatgacggcgtcccctgtgtcttccccttcatrttcaatgggaagagctacgaggagtgcatcatagagagcagggcgaagctgtggtgtagcacaactgcggactacgacagagaccacgagtggggcttct

SEQ ID NO: 7628 - DNA, 201 bp, Homo sapiens
acctctcgtccctgtcaaggtacagtgacaactgggaagccatcactgggacgggggacccggagcactacctcatcaatgtctgcaagtctctggccccrcaggctggcactgagccgtgccctccagaagcagccgcgtgtctgctgggtggctccaagcccgtgaacctcggcagggtaagggacggacctcagtgga

SEQ ID NO: 7629 - DNA, 201 bp, Homo sapiens
cagggtttcagcggatgagcgtcataaactttgagtgcaataaaaccgcaggtaacgatgggaaaggaactcctgtattcacaggggaggttgactgcacytacttcttcacatgggacacggaatacgcctgtgttaaggagaaggaagacctcctctgcggtgccaccgacgggaagaagcgctatgacctgtccgcgc

SEQ ID NO: 7630 - DNA, 201 bp, Homo sapiens
aaaactaatatcacacttgtatgcaagccaggtgatctggaaagtgcaccagtgttgagaacttctggggaaggcggttgcttttatgagtttgagtggcrcacagctgcggcctgtgtgctgtctaagacagaaggggagaactgcacggtctttgactcccaggcagggttttcttttgacttatcacctctcacaaag

SEQ ID NO: 7631 - DNA, 201 bp, Homo sapiens
caccaggcgtttgatgttggccagccccgggacggactgaagctggtgcgcaaggacaggcttgtcctgagttacgtgagggaagaggcaggaaagctagrcttttgtgatggtcacagccctgcggtgactattacatttgtttgcccgtcggagcggagagagggcaccattcccaaactcacagctaaatccaactgc

SEQ ID NO: 7632 - DNA, 201 bp, Homo sapiens
aatctgggtgtggtgcagatgagtccccaagccgcggcgaatggatctttgagcatcatgtatgtcaacggtgacaagtgtgggaaccagcgcttctccascaggatcacgtttgagtgtgctcagatatcgggctcaccagcatttcagcttcaggatggttgtgagtacgtgtttatctggagaactgtggaagcctgt

SEQ ID NO: 7633 - DNA, 201 bp, Homo sapiens
actggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagatatcggccgggtagcaggaccaccaatactcaatccaata

SEQ ID NO: 7634 - DNA, 201 bp, Homo sapiens
tggaaatgagtacgacctgactggcctaagcacagtcaggaaaccttggacggctgttgacacctctgtcgatgggagaaagaggactttctatttgagcrtttgcaatcctctcccttacattcctggatgccagggcagcgcagtggggtcttgcttagtgtcagaaggcaatagctggaatctgggtgtggtgcagat

SEQ ID NO: 7635 - DNA, 201 bp, Homo sapiens
gcgttggcctgtgttccttctccagtggactgccaagtcaccgacctggctggaaatgagtacgacctgactggcctaagcacagtcaggaaaccttggayggctgttgacacctctgtcgatgggagaaagaggactttctatttgagcgtttgcaatcctctcccttacattcctggatgccagggcagcgcagtgggg

SEQ ID NO: 7636 - DNA, 201 bp, Homo sapiens
gtggatgactccgatccggacacttctctattcatcaatgtttgtagagacatagacacactacgagacccaggttcacagctgcgggcctgtccccccgrcactgccgcctgcctggtaagaggacaccaggcgtttgatgttggccagccccgggacggactgaagctggtgcgcaaggacaggcttgtcctgagttac

SEQ ID NO: 7637 - DNA, 201 bp, Homo sapiens
cgagccgcgctcacctcgggctcccgctccgtctccacctccgcctttgccctggcggcgcgaccccgtcccgggcgcggcccccagcagtcgcgcgccgytagcctcgcgcccgccgcgcagtccgggccccgcccgatgggggccgccgccggccggagcccccacctggggcccgcgcccgcccgccgcccgcagcgc

SEQ ID NO: 7638 - DNA, 201 bp, Homo sapiens
actcagggcccctcaaattcctgcatcaagatatcgactctgggcaagggatccgaaacacttactttgagtttgaaaccgcgttggcctgtgttccttcyccagtggactgccaagtcaccgacctggctggaaatgagtacgacctgactggcctaagcacagtcaggaaaccttggacggctgttgacacctctgtcg

SEQ ID NO: 7639 - DNA, 201 bp, Homo sapiens
atgccatggacaactcaggggaacatgtcacgtggaggaaatactacattaacgtgtgtcggcctctgaatccagtgccgggctgcaaccgatatgcatcrgcttgccagatgaagtatgaaaaagatcagggctccttcactgaagtggtttccatcagtaacttgggaatggcaaagaccggcccggtggttgaggaca

SEQ ID NO: 7640 - DNA, 201 bp, Homo sapiens
atgggccagagcctcggccctagcattgcacttggcctcatgctggagggaggctgggcgggtacagcgcggaggaggagggaggccaggcgggcatggcrtggaggaggagggaggccgggcggtcacagcatggaggaggagggaggcgctgctggtgttcttattctggcggcagcgcctttcctgccatgtttagtg

SEQ ID NO: 7641 - DNA, 201 bp, Homo sapiens
ggtatgccatggacaactcaggggaacatgtcacgtggaggaaatactacattaacgtgtgtcggcctctgaatccagtgccgggctgcaaccgatatgcrtcggcttgccagatgaagtatgaaaaagatcagggctccttcactgaagtggtttccatcagtaacttgggaatggcaaagaccggcccggtggttgagg

SEQ ID NO: 7642 - DNA, 201 bp, Homo sapiens
cacctccgcctttgccctggcggcgcgaccccgtcccgggcgcggcccccagcagtcgcgcgccgttagcctcgcgcccgccgcgcagtccgggccccgcscgatgggggccgccgccggccggagcccccacctggggcccgcgcccgcccgccgcccgcagcgctctctgctcctgctgcagctgctgctgctcgtcgc

SEQ ID NO: 7643 - DNA, 201 bp, Homo sapiens
taagaaaaaagtgttgatcaaccattcgacctataagaagccttaatttgcacagtgtgtgacttacagaaactgcatgaaaaatcatgggccagagcctyggccctagcattgcacttggcctcatgctggagggaggctgggcgggtacagcgcggaggaggagggaggccaggcgggcatggcgtggaggaggaggga

SEQ ID NO: 7644 - DNA, 201 bp, Homo sapiens
ggcaaaatctgaaggtggccttggaggaaactggtatgccatggacaactcaggggaacatgtcacgtggaggaaatactacattaacgtgtgtcggcctstgaatccagtgccgggctgcaaccgatatgcatcggcttgccagatgaagtatgaaaaagatcagggctccttcactgaagtggtttccatcagtaactt

SEQ ID NO: 7645 - DNA, 201 bp, Homo sapiens
ctccacctccgcctttgccctggcggcgcgaccccgtcccgggcgcggcccccagcagtcgcgcgccgttagcctcgcgcccgccgcgcagtccgggcccsgcccgatgggggccgccgccggccggagcccccacctggggcccgcgcccgcccgccgcccgcagcgctctctgctcctgctgcagctgctgctgctcgt

SEQ ID NO: 7646 - DNA, 201 bp, Homo sapiens
tctcttttctcttttgctttctgtttcttaagggcacacacacgtgcgtgcgagcacacacacacatacgtgcacagggtccccgagtgcctaggttttgragagtttgcctgttctatgcctttagtcaggaatggctgcacctttttgcatgatatcttcaagcctgggcgtacagagcacatttgtcagtatttttgc

SEQ ID NO: 7647 - DNA, 201 bp, Homo sapiens
ctggagccaacatatgccaggtgaagcccaacgatcagcacttcagtcggaaagttggaacctctgacaagaccaagtactaccttcaagacggcgatctygatgtcgtgtttgcctcttcctctaagtgcggaaaggataagaccaagtctgtttcttccaccatcttcttccactgtgaccctctggtggaggacggga

SEQ ID NO: 7648 - DNA, 201 bp, Homo sapiens
ccacagcctgtcccatgaagagcaacgagcatgatgactgccaggtcaccaacccaagcacaggacacctgtttgatctgagctccttaagtggcagggcrggattcacagctgcttacagcgagaaggggttggtttacatgagcatctgtggggagaatgaaaactgccctcctggcgtgggggcctgctttggacaga

SEQ ID NO: 7649 - DNA, 201 bp, Homo sapiens
gttttgccccaagtcctcatttaaaagcataaggccggacgcatctcaaaacagagggctgcattcgaagaaacccttgctgctttagtcccgatagggtrtttgaccccgatatattttagcattttaattctctccccctatttattgactttgacaattactcaggtttgagaaaaaggaaaaaaaaacagccaccgt

SEQ ID NO: 7650 - DNA, 201 bp, Homo sapiens
gaaaaaaaaacagccaccgtttcttcctgccagcaggggtgtgatgtaccagtttgtccatcttgagatggtgaggctgtcagtgtatggggcagcttccrgcgggatgttgaactggtcattaatgtgtcccctgagttggagctcattctgtctcttttctcttttgctttctgtttcttaagggcacacacacgtgcg

SEQ ID NO: 7651 - DNA, 201 bp, Homo sapiens
gtgcccagggttttgccccaagtcctcatttaaaagcataaggccggacgcatctcaaaacagagggctgcattcgaagaaacccttgctgctttagtccygatagggtatttgaccccgatatattttagcattttaattctctccccctatttattgactttgacaattactcaggtttgagaaaaaggaaaaaaaaac

SEQ ID NO: 7652 - DNA, 201 bp, Homo sapiens
tgccctccaaagaagttggagtgcaaattcgtccagaaacacaaaacctacgacctgcggctgctctcctctctcaccgggtcctggtccctggtccacaycggagtctcgtactatataaatctgtgccagaaaatatataaagggcccctgggctgctctgaaagggccagcatttgcagaaggaccacaactggtgac

SEQ ID NO: 7653 - DNA, 201 bp, Homo sapiens
agtttttgtgatgggggagagggtgaaggaggtcaggccccactccttcctgattgtttacagtcattggaataaggcatggctcagatcggccacagggyggtaccttgtgcccagggttttgccccaagtcctcatttaaaagcataaggccggacgcatctcaaaacagagggctgcattcgaagaaacccttgctgc

SEQ ID NO: 7654 - DNA, 201 bp, Homo sapiens
ggagctggggcagagagctcccacccagtgagaaacgcacagagcaatgcccttcaggagcgtgaggacgatagggtggggctggtcaggggtgagaaggygaggaaagggaagtccagctctgcacagcagaagacagtgagctccaccaagctggtgtccttccatgacgacagcgacgaggacctcttacacatctga

SEQ ID NO: 7655 - DNA, 176 bp, Homo sapiens
tattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaa

SEQ ID NO: 7656 - DNA, 201 bp, Homo sapiens
atgaaaaatcatgggccagagcctcggccctagcattgcacttggcctcatgctggagggaggctgggcgggtacagcgcggaggaggagggaggccaggygggcatggcgtggaggaggagggaggccgggcggtcacagcatggaggaggagggaggcgctgctggtgttcttattctggcggcagcgcctttcctgcc

SEQ ID NO: 7657 - DNA, 201 bp, Homo sapiens
agaattgggaagctgtggatggcagtcagacggaaacagagaagaagcattttttcattaatatttgtcacagagtgctgcaggaaggcaaggcacgaggrtgtcccgaggacgcggcagtgtgtgcagtggataaaaatggaagtaaaaatctgggaaaatttatttcctctcccatgaaagagaaaggaaacattcaac

SEQ ID NO: 7658 - DNA, 201 bp, Homo sapiens
aaaaagtgttgatcaaccattcgacctataagaagccttaatttgcacagtgtgtgacttacagaaactgcatgaaaaatcatgggccagagcctcggccmtagcattgcacttggcctcatgctggagggaggctgggcgggtacagcgcggaggaggagggaggccaggcgggcatggcgtggaggaggagggaggccg

SEQ ID NO: 7659 - DNA, 201 bp, Homo sapiens
ctccccaccacaactaaataaaaattcaagtggaatatattctgaagctttgcttactacaaatatagtgccaatgtaccagagttttcaagttatatggygctactttcatgacaccctactgcgaaagtatgctgaagaaagaaatggtgtcaatgtcgtcagtggtcctgtgtttgactttgattatgatggacgttg

SEQ ID NO: 7660 - DNA, 201 bp, Homo sapiens
tgtatgatcccaaaatgaatgcttccttttcacttaaaagtaaagagaaatttaatcctgagtggtacaaaggagaaccaatttgggtcacagctaagtakcaaggcctcaagtctggcacatttttctggccaggatcagatgtggaaattaacggaattttcccagacatctataaaatgtataatggttcagtaccat

SEQ ID NO: 7661 - DNA, 201 bp, Homo sapiens
ccctctttgttggctatggacctggattcaagcatggcattgaggctgacacctttgaaaacattgaagtctataacttaatgtgtgatttactgaatttsacaccggctcctaataacggaactcatggaagtcttaaccaccttctaaagaatcctgtttatacgccaaagcatcccaaagaagtgcaccccctggtac

SEQ ID NO: 7662 - DNA, 201 bp, Homo sapiens
atatggacttgcaacaaattcaggtgtggtgagaaaaggttgaccagaagcctctgtgcctgttcagatgactgcaaggacaagggcgactgctgcatcarctacagttctgtgtgtcaaggtgagaaaagttgggtagaagaaccatgtgagagcattaatgagccacagtgcccagcagggtttgaaacgcctcctacc

SEQ ID NO: 7663 - DNA, 137 bp, Homo sapiens
atttacaactcaaaattatttaataatttaggaagttgctttttttttttttttttttcagtcctgcagtttcctgaagctctgtatatgatatttttttyagcctgcttctctctgttgttcagattaggtaattt

SEQ ID NO: 7664 - DNA, 199 bp, Homo sapiens
tccttcgtgtgaccattctttaacggcctaagggccagctgcaaagacttttggaaaatacaatttacaactcaaaattatttaataatttaggaagttgytttttttttttttttttttcagtcctgcagtttcctgaagctctgtatatgatatttttttcagcctgcttctctctgttgttcagattaggtaattt

SEQ ID NO: 7665 - DNA, 200 bp, Homo sapiens
gtccttcgtgtgaccattctttaacggcctaagggccagctgcaaagacttttggaaaatacaatttacaactcaaaattatttaataatttaggaagttkctttttttttttttttttttcagtcctgcagtttcctgaagctctgtatatgatatttttttcagcctgcttctctctgttgttcagattaggtaattt

SEQ ID NO: 7666 - DNA, 201 bp, Homo sapiens
ctttttgtccctacctgtgaaccttcaaagactgcattaacttttaggctacataggtccaattgaggtataatatcagtacaccaaagatttttatatgyccttcgtgtgaccattctttaacggcctaagggccagctgcaaagacttttggaaaatacaatttacaactcaaaattatttaataatttaggaagttgc

SEQ ID NO: 7667 - DNA, 201 bp, Homo sapiens
accttagctttcattttgcctcacaggactgataacagcgagagctgtgtgcatgggaagcatgactcctcatgggttgaagaattgttaatgttacacasagcacggatcacagatgttgagcacatcactggactcagcttctatcaacaaagaaaagagccagtttcagacattttaaagttgaaaacacatttgcca

SEQ ID NO: 7668 - DNA, 201 bp, Homo sapiens
acaatgaacttgatttctttactaccttgactgtagctttttgtccctacctgtgaaccttcaaagactgcattaacttttaggctacataggtccaattkaggtataatatcagtacaccaaagatttttatatgtccttcgtgtgaccattctttaacggcctaagggccagctgcaaagacttttggaaaatacaatt

SEQ ID NO: 7669 - DNA, 201 bp, Homo sapiens
gtctgaaagagctgaacttgcacagatgcctgaacctcatccttatttcagatcatggcatggaacaaggcagttgtaagaaatacatatatctgaataartatttgggggatgttaaaaatattaaagttatctatggacctgcagctcgattgagaccctctgatgtcccagataaatactattcatttaactatgaag

SEQ ID NO: 7670 - DNA, 201 bp, Homo sapiens
attgaagagaacatgccaccaatcacctcacatcttcttggtggacatgataaatgacacaatgaacttgatttctttactaccttgactgtagctttttrtccctacctgtgaaccttcaaagactgcattaacttttaggctacataggtccaattgaggtataatatcagtacaccaaagatttttatatgtccttcg

SEQ ID NO: 7671 - DNA, 201 bp, Homo sapiens
gaatttgacaccggctcctaataacggaactcatggaagtcttaaccaccttctaaagaatcctgtttatacgccaaagcatcccaaagaagtgcaccccstggtacagtgccccttcacaagaaaccccagagataaccttggctgctcatgtaacccttcgattttgccgattgaggattttcaaacacagttcaatct

SEQ ID NO: 7672 - DNA, 201 bp, Homo sapiens
gataaatgacacaatgaacttgatttctttactaccttgactgtagctttttgtccctacctgtgaaccttcaaagactgcattaacttttaggctacatmggtccaattgaggtataatatcagtacaccaaagatttttatatgtccttcgtgtgaccattctttaacggcctaagggccagctgcaaagacttttgga

SEQ ID NO: 7673 - DNA, 201 bp, Homo sapiens
ttgtatatttgggttgaaaccaagctgtgccaaagaagttaaaagttgcaaaggtcgctgtttcgagagaacatttgggaactgtcgctgtgatgctgccygtgttgagcttggaaactgctgtttagattaccaggagacgtgcatagaaccagaacatatatggacttgcaacaaattcaggtgtggtgagaaaaggtt

SEQ ID NO: 7674 - DNA, 201 bp, Homo sapiens
actacaaatatagtgccaatgtaccagagttttcaagttatatggcgctactttcatgacaccctactgcgaaagtatgctgaagaaagaaatggtgtcartgtcgtcagtggtcctgtgtttgactttgattatgatggacgttgtgattccttagagaatctgaggcaaaaaagaagagtcatccgtaaccaagaaatt

SEQ ID NO: 7675 - DNA, 201 bp, Homo sapiens
accttcaaagactgcattaacttttaggctacataggtccaattgaggtataatatcagtacaccaaagatttttatatgtccttcgtgtgaccattcttyaacggcctaagggccagctgcaaagacttttggaaaatacaatttacaactcaaaattatttaataatttaggaagttgctttttttttttttttttttc

SEQ ID NO: 7676 - DNA, 201 bp, Homo sapiens
ggagacgtgcatagaaccagaacatatatggacttgcaacaaattcaggtgtggtgagaaaaggttgaccagaagcctctgtgcctgttcagatgactgcmaggacaagggcgactgctgcatcaactacagttctgtgtgtcaaggtgagaaaagttgggtagaagaaccatgtgagagcattaatgagccacagtgccc

SEQ ID NO: 7677 - DNA, 201 bp, Homo sapiens
tttcatttcttttcattgtaatcaaaaaaaaaattaacagaagccaaaatacttctgagaccttgtttcaatctttgctgtatatcccctcaaaatccaarttattaatcttatgtgttttctttttaattttttgattggatttctttagatttaatggttcaaatgagttcaactttgagggacgatctttgaatatac

SEQ ID NO: 7678 - DNA, 201 bp, Homo sapiens
acaaaaactttccccaatcactacagcattgtcaccggattgtatccagaatctcatggcataatcgacaataaaatgtatgatcccaaaatgaatgcttycttttcacttaaaagtaaagagaaatttaatcctgagtggtacaaaggagaaccaatttgggtcacagctaagtatcaaggcctcaagtctggcacattt

SEQ ID NO: 7679 - DNA, 201 bp, Homo sapiens
tggcattgggcaaacagtagacttatagtagggttggggtagcccatgttatgtgactatctttatgagaattttaaagtggttctggatatcttttaacwtggagtttcatttcttttcattgtaatcaaaaaaaaaattaacagaagccaaaatacttctgagaccttgtttcaatctttgctgtatatcccctcaaaa

SEQ ID NO: 7680 - DNA, 201 bp, Homo sapiens
tctagctacactattgcattgttcagaaactgtcgaccagagttagaacggagccctcggtgatgcggacatctcagggaaacttgcgtactcagcacagyagtggagagtgttcctgttgaatcttgcacatatttgaatgtgtaagcattgtatacattgatcaagttcgggggaataaagacagaccacacctaaaac

SEQ ID NO: 7681 - DNA, 201 bp, Homo sapiens
accatgaatctttttgagagaaccttatattttatatagtcctctagctacactattgcattgttcagaaactgtcgaccagagttagaacggagccctcsgtgatgcggacatctcagggaaacttgcgtactcagcacagcagtggagagtgttcctgttgaatcttgcacatatttgaatgtgtaagcattgtataca

SEQ ID NO: 7682 - DNA, 201 bp, Homo sapiens
tccccaaacaccatgaatctttttgagagaaccttatattttatatagtcctctagctacactattgcattgttcagaaactgtcgaccagagttagaacrgagccctcggtgatgcggacatctcagggaaacttgcgtactcagcacagcagtggagagtgttcctgttgaatcttgcacatatttgaatgtgtaagca

SEQ ID NO: 7683 - DNA, 201 bp, Homo sapiens
tagctttcattttgcctcacaggactgataacagcgagagctgtgtgcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacct

SEQ ID NO: 7684 - DNA, 201 bp, Homo sapiens
gtgcatagaaccagaacatatatggacttgcaacaaattcaggtgtggtgagaaaaggttgaccagaagcctctgtgcctgttcagatgactgcaaggacmagggcgactgctgcatcaactacagttctgtgtgtcaaggtgagaaaagttgggtagaagaaccatgtgagagcattaatgagccacagtgcccagcagg

SEQ ID NO: 7685 - DNA, 201 bp, Homo sapiens
aaataaaaattcaagtggaatatattctgaagctttgcttactacaaatatagtgccaatgtaccagagttttcaagttatatggcgctactttcatgacmccctactgcgaaagtatgctgaagaaagaaatggtgtcaatgtcgtcagtggtcctgtgtttgactttgattatgatggacgttgtgattccttagagaa

SEQ ID NO: 7686 - DNA, 201 bp, Homo sapiens
aagtagctgtgaacattgtctggataccagatatttgaatctttcttactattggtaataaaccttgatggcattgggcaaacagtagacttatagtaggrttggggtagcccatgttatgtgactatctttatgagaattttaaagtggttctggatatcttttaacttggagtttcatttcttttcattgtaatcaaaa

SEQ ID NO: 7687 - DNA, 201 bp, Homo sapiens
tcacaggactgataacagcgagagctgtgtgcatgggaagcatgactcctcatgggttgaagaattgttaatgttacacagagcacggatcacagatgttkagcacatcactggactcagcttctatcaacaaagaaaagagccagtttcagacattttaaagttgaaaacacatttgccaacctttagccaagaagactg

SEQ ID NO: 7688 - DNA, 201 bp, Homo sapiens
caactttgagggacgatctttgaatatacttacctattataaaatcttactttgtatttgtatttaaaaaagaaaaatattcctatcctgctcactggtarttaacataggtttaaaatggcttcaaatgtggccctatagacggttaaaattgtaccttatcttggcaaaacttcagagcaccagtcagtgcatgcaagg

SEQ ID NO: 7689 - DNA, 201 bp, Homo sapiens
gattgaggattttcaaacacagttcaatctgactgtggcagaagagaagattattaagcatgaaactttaccctatggaagacctagagttctccagaagraaaacaccatctgtcttctttcccagcaccagtttatgagtggatacagccaagacatcttaatgcccctttggacatcctataccgtggacagaaatgc

SEQ ID NO: 7690 - DNA, 201 bp, Homo sapiens
ggacatcctataccgtggacagaaatgcaatttctctacggaagacttctccaactgtctgtaccaggactttagaattcctcttagtcctgtccataaaygttcattttataaaaataacaccaaagtgagttacgggttcctctccccaccacaactaaataaaaattcaagtggaatatattctgaagctttgcttac

SEQ ID NO: 7691 - DNA, 201 bp, Homo sapiens
ctgaggtcgcccagcaagagttcctcgaagttaagcaaagagtgaacagtggttgtgtgatgatggaaaacaagctggaggggattggccagtttcactgycgggtccgagagatgttctctcaattggcagacctggatgatgagctagatggcatgggtgctattggcagagacactgatagcctccagtcccaaatcg

SEQ ID NO: 7692 - DNA, 201 bp, Homo sapiens
gtacctcctggagaagagaaaaggactctacaaaaccagttggttgagctcaaaaaccattgggaagagcttagtaaaaaaactgcagacagacaatccasgctcaaggattgtatgcagaaagctcagaaatatcagtggcatgtggaagaccttgtgccatggatagaagattgtaaagctaagatgtctgagttgcga

SEQ ID NO: 7693 - DNA, 152 bp, Homo sapiens
atgtcttcctcagatgaagagacgctcagtgagcggtcatgtcggagtgagyggtcttgtcggagtgagcgatcttacaggagcgagcggtcggggagcctgtctccctgtcccccaggggacaccttgccctggaacctgccactgcatga

SEQ ID NO: 7694 - DNA, 201 bp, Homo sapiens
tctgaggaactttactcagggtctggtagaagatgccccagatggatctgatgcttctcaacttctccaccaagctgaggtcgcccagcaagagttcctckaagttaagcaaagagtgaacagtggttgtgtgatgatggaaaacaagctggaggggattggccagtttcactgccgggtccgagagatgttctctcaatt

SEQ ID NO: 7695 - DNA, 201 bp, Homo sapiens
agagaaaaggactctacaaaaccagttggttgagctcaaaaaccattgggaagagcttagtaaaaaaactgcagacagacaatccaggctcaaggattgtrtgcagaaagctcagaaatatcagtggcatgtggaagaccttgtgccatggatagaagattgtaaagctaagatgtctgagttgcgagtcactctggatcc

SEQ ID NO: 7696 - DNA, 201 bp, Homo sapiens
aaaggactctacaaaaccagttggttgagctcaaaaaccattgggaagagcttagtaaaaaaactgcagacagacaatccaggctcaaggattgtatgcasaaagctcagaaatatcagtggcatgtggaagaccttgtgccatggatagaagattgtaaagctaagatgtctgagttgcgagtcactctggatccagtgc

SEQ ID NO: 7697 - DNA, 193 bp, Homo sapiens
atgtcttcctcagatgaagagacgctcagtgagcggtcatgtcggagtgagcggtcttgtcggagtgagcgatcttacaggagcgagcggtcrgggagcctgtctccctgtcccccaggggacaccttgccctggaacctgccactgcatgagcagaaaaagcggaaaagccaggattcggtgctggaccctg

SEQ ID NO: 7698 - DNA, 201 bp, Homo sapiens
tacaaaaccagttggttgagctcaaaaaccattgggaagagcttagtaaaaaaactgcagacagacaatccaggctcaaggattgtatgcagaaagctcasaaatatcagtggcatgtggaagaccttgtgccatggatagaagattgtaaagctaagatgtctgagttgcgagtcactctggatccagtgcagctagagt

SEQ ID NO: 7699 - DNA, 201 bp, Homo sapiens
gcagaaagctcagaaatatcagtggcatgtggaagaccttgtgccatggatagaagattgtaaagctaagatgtctgagttgcgagtcactctggatccastgcagctagagtccagtctcctaagatcaaaggctatgctgaatgaggtggagaagcgccgctccctgctggaaatattgaatagtgctgctgacattct

SEQ ID NO: 7700 - DNA, 201 bp, Homo sapiens
agaattctccaaaaattcaaaaagtaaaggaagccctggctggattactggtgacatatcccaactcacaggaagcagaaaattggaagaaaattcaggargaactcaattcccgatgggaaagggccactgaggttactgtggctcggcaaaggcagctagaggaatctgcaagtcatctggcctgcttccaggctgcag

SEQ ID NO: 7701 - DNA, 201 bp, Homo sapiens
ctggtagaagatgccccagatggatctgatgcttctcaacttctccaccaagctgaggtcgcccagcaagagttcctcgaagttaagcaaagagtgaacastggttgtgtgatgatggaaaacaagctggaggggattggccagtttcactgccgggtccgagagatgttctctcaattggcagacctggatgatgagcta

SEQ ID NO: 7702 - DNA, 201 bp, Homo sapiens
gtgatgggaagatgttcaatgcactcattcaccgataccgacccgatctagtagacatggagagggtgcaaatccaaagtaaccgagagaatctggaacargcttttgaagtggcagaaagactgggggtcactcgcctgctggatgcagaagatgtggatgtgccatctccagatgaaaagtctgtaatcacttatgtgt

SEQ ID NO: 7703 - DNA, 201 bp, Homo sapiens
agtttcactgccgggtccgagagatgttctctcaattggcagacctggatgatgagctagatggcatgggtgctattggcagagacactgatagcctccastcccaaatcgaggatgtccggctattccttaacaaaattcacgtcctcaaattagacatagaggcctctgaagcagagtgtcgacatatgctagaagaag

SEQ ID NO: 7704 - DNA, 201 bp, Homo sapiens
agactgaaaagagtaaagcagcaaaggaactggcagagaacaagaagaagatcgatgctctcctggattgggtaacttcagtaggatcatctggtggacakctgctgaccaaccttccaggaatggagcagctctcgggagctagcttggagaaaggagccttggacaccactgatggttacatgggggtgaatcaagccc

SEQ ID NO: 7705 - DNA, 201 bp, Homo sapiens
aaagcgagtggacgttaactcagcagtagccatgggagaagtcatcctggctgtctgccaccccgattgcatcacaaccatcaaacactggatcaccatcrtccgagctcgcttcgaggaggtcctgacatgggctaagcagcaccagcagcgtcttgaaacggccttgtcagaactggtggctaatgctgagctcctgga

SEQ ID NO: 7706 - DNA, 201 bp, Homo sapiens
tatgctgaatgaggtggagaagcgccgctccctgctggaaatattgaatagtgctgctgacattctgatcaattcttcagaagcagatgaggatggaatcygggatgagaaggctgggatcaaccagaacatggatgctgttacagaagagctgcaggccaaaacagggtcactcgaagaaatgactcagaggctcaggga

SEQ ID NO: 7707 - DNA, 201 bp, Homo sapiens
agagcctcaggtagactatctgaggaactttactcagggtctggtagaagatgccccagatggatctgatgcttctcaacttctccaccaagctgaggtcrcccagcaagagttcctcgaagttaagcaaagagtgaacagtggttgtgtgatgatggaaaacaagctggaggggattggccagtttcactgccgggtccg

SEQ ID NO: 7708 - DNA, 201 bp, Homo sapiens
attgagatggagaagcttaatcaccagggtgaactgatgttaaagaaagctactgatgagacggacagagacattatacgagaaccactgacagaactcaracacctctgggagaacctgggtgagaaaattgcccaccgacagcacaaactagaaggggctctgttggcccttggtcagttccagcatgccttagaggaa

SEQ ID NO: 7709 - DNA, 201 bp, Homo sapiens
ggctcatcaagccacagtggaaacagtcaacaaagctggcaatgagcttcttgaatccagtgctggagatgatgccagcagcttaaggagccgtttggaarccatgaaccaatgctgggagtcagtgttacagaaaacagaggagagggagcagcagcttcagtcaactctgcagcaggcccagggcttccacagtgaaat

SEQ ID NO: 7710 - DNA, 201 bp, Homo sapiens
catgtgaaagagaatactgcttattttcagttcttcagtgatgcacgagagctggagtcattcttgaggaacctccaagattccattaaacgaaaatattsctgtgaccacaacaccagcttatcccgccttgaagacctgctccaggactccatggatgaaaaggagcagcttatacagtccaagagttccgttgccagt

SEQ ID NO: 7711 - DNA, 201 bp, Homo sapiens
gatacacatatggaactctattcccagctgaaagccaaggaagagacttataatcaactacttgacaagggcagactcatgcttctaagccgtgacgactstgggtctggctccaagacagaacagagtgtagcacttttggagcagaagtggcatgtggtcagcagtaagatggaagaaagaaagtcaaagctggaagag

SEQ ID NO: 7712 - DNA, 201 bp, Homo sapiens
cagaacagagtgtagcacttttggagcagaagtggcatgtggtcagcagtaagatggaagaaagaaagtcaaagctggaagaggccctcaacttggcaacmgaattccagaattccctacaagaatttatcaactggctcactctagcagagcagagtttaaacatcgcttctccaccaagcctgattctaaatactgtcc

SEQ ID NO: 7713 - DNA, 201 bp, Homo sapiens
agagaccaataagtggagacccaaaagtcattgaagttgagctcgcaaagcaccatgtcctaaaaaatgatgttttggctcatcaagccacagtggaaacmgtcaacaaagctggcaatgagcttcttgaatccagtgctggagatgatgccagcagcttaaggagccgtttggaagccatgaaccaatgctgggagtcag

SEQ ID NO: 7714 - DNA, 201 bp, Homo sapiens
aatgcattaaggattgcagagcaagagcacacccaggaggatttacagcaattgaggtcagacttggatgcagtttctatgaaatgtgacagctttctccwtcagtctccatctagttcaagtgtcccaactctgcgctcagaactgaatctgctggtggagaagatggaccatgtctatggtctctctactgtatatctg

SEQ ID NO: 7715 - DNA, 201 bp, Homo sapiens
ccaggcaaaaacagctggaagacatcctggttctggccaaacagttccatgagacagctgagcctatttctgacttcttatctgtcacagagaaaaagctkgctaactcagaacctgttggcactcagactgccaaaatacagcagcagatcattcggcacaaggctctggaagaagacatagaaaaccatgcaacagatg

SEQ ID NO: 7716 - DNA, 201 bp, Homo sapiens
ttagtgatgtgaaggacaagaattcagtgttttcagtcctggatgaggaaattgccaaggccaaggtagtggcagagcagatgagtcgtctgacaccagarcgaaatctggatttggagcgctatcaggaaaaaggctcccagctgcaggagcgttggcaccgagtcattgcccagctcgagattcgccaatctgagctag

SEQ ID NO: 7717 - DNA, 201 bp, Homo sapiens
gaccaaagaatcaacagacattgaaaaagctattttggaacagcaggttctgtcagaagagctgacaacaaagaaagaacaagtctctgaagctattaaarcatcacagatcttcttggccaagcatggtcataagctctcagaaaaagagaagaaacaaatatctgagcaattgaatgccctaaacaaggcttaccatga

SEQ ID NO: 7718 - DNA, 157 bp, Homo sapiens
atgtcttcctcagatgaagagacgctcagtgagcggtcatgtcggagtgagcggtcwtgtcggagtgagcgatcttacaggagcgagcggtcggggagcctgtctccctgtcccccaggggacaccttgccctggaacctgccactgcatgagcaga

SEQ ID NO: 7719 - DNA, 201 bp, Homo sapiens
caatgtgagatgatgaaggcccgtcaccaagaattgctgtcccagcagcaaaatttcattctggccacccagtcagctcaggccttcttggatcagcatgsccacaatctcacacctgaggagcaacagatgctgcaacagaagctgggagagctaaaggaacaatactctacttccctggcccaatcagaggcagaactg

SEQ ID NO: 7720 - DNA, 201 bp, Homo sapiens
ggaccttgacctcgtcatgaacctcatggatgcacacaaggttttccagaaggaactgggaaagcgaacaggaaccgttcaggtcctgaagcggtcaggcmgagagctgattgagaatagtcgagatgacaccacttgggtaaaaggacagctccaggaactgagcactcgctgggacactgtctgtaaactctctgtttc

SEQ ID NO: 7721 - DNA, 201 bp, Homo sapiens
tcccatcatcaggtagcaagttgaaacgaccaacaccaacttttcattctagtcggacatcccttgctggtgataccagcaatagttcttccccggcctcyacaggtgccaaaactaatcgggcagaccctaaaaagtctgccagtcgccctgggagtcgggctgggagtcgagccgggagtcgagccagcagccggcgag

SEQ ID NO: 7722 - DNA, 201 bp, Homo sapiens
ggaggatttacagcaattgaggtcagacttggatgcagtttctatgaaatgtgacagctttctccatcagtctccatctagttcaagtgtcccaactctgygctcagaactgaatctgctggtggagaagatggaccatgtctatggtctctctactgtatatctgaataagttaaagacagttgatgttatagtacgtag

SEQ ID NO: 7723 - DNA, 201 bp, Homo sapiens
atgaggtgattgtggctgaaggggaatctctacttctttctgtacctcctggagaagagaaaaggactctacaaaaccagttggttgagctcaaaaaccaytgggaagagcttagtaaaaaaactgcagacagacaatccaggctcaaggattgtatgcagaaagctcagaaatatcagtggcatgtggaagaccttgtgc

SEQ ID NO: 7724 - DNA, 201 bp, Homo sapiens
gtgacttgaaggatttacaggatgacattcagaatcgtgccacctcatttgccactgttgtcaaggacattgaggggttcatggaagagaatcagaccaarctgagcccacgtgagttgacagctcttcgggaaaagcttcatcaggctaaggagcaatatgaggcgctccaggaagagacacgtgtggcccagaaggaac

SEQ ID NO: 7725 - DNA, 201 bp, Homo sapiens
cgatgggaaagggccactgaggttactgtggctcggcaaaggcagctagaggaatctgcaagtcatctggcctgcttccaggctgcagaatcccagctccrgccgtggctgatggagaaagaactgatgatgggagtgctggggcccctgtctattgaccccaacatgttgaatgcacaaaagcaacaggtccagtttatg

SEQ ID NO: 7726 - DNA, 201 bp, Homo sapiens
aacaaaacctggaagggaagcaggtgtcatcactctcatcaggagtcatccaggaagccttagccacaaatatgaaattgaagcaggacattgctcggcaraagagcagcttggaggccacccgtgagatggtgacccgattcatggagacagcagacagtactacagcagcagtgctgcagggcaaactggcagaggtga

SEQ ID NO: 7727 - DNA, 201 bp, Homo sapiens
aaactgaagggagtattccacctacggaaacttctatgagtgctaaagagttagaaaagcagattgaacacctgaagagtctactagatgactgggcaagyaagggaactctggtggaagaaatcaattgcaaaggtacttctttagaaaatctcatcatggaaatcacagcacctgattcccaaggcaagacaggttcca

SEQ ID NO: 7728 - DNA, 201 bp, Homo sapiens
caggtcctgaagcggtcaggccgagagctgattgagaatagtcgagatgacaccacttgggtaaaaggacagctccaggaactgagcactcgctgggacaytgtctgtaaactctctgtttccaaacaaagccggcttgagcaggccttaaaacaagcggaagtgtttcgagacacagtccacatgctgttggagtggctt

SEQ ID NO: 7729 - DNA, 201 bp, Homo sapiens
caaacaccaacttgagatctttgatgctctgggttctcaagcctgtagcaacaagaacctggagaagctaagagctcaacaggaagtgctgcaggccctakagcctcaggtagactatctgaggaactttactcagggtctggtagaagatgccccagatggatctgatgcttctcaacttctccaccaagctgaggtcgc

SEQ ID NO: 7730 - DNA, 201 bp, Homo sapiens
atcttgccaggaacagttggatgaattccggaagctggtcaggaccttccagaaatggttgaaagaaactgaagggagtattccacctacggaaacttctrtgagtgctaaagagttagaaaagcagattgaacacctgaagagtctactagatgactgggcaagtaagggaactctggtggaagaaatcaattgcaaagg

SEQ ID NO: 7731 - DNA, 201 bp, Homo sapiens
gcgggatcaggagccaatcccgcagaacattgaccgagttaaagcccttatcgctgagcatcagacatttatggaggagatgactcgcaaacagcctgacrtggaccgggtcaccaagacatacaaaaggaaaaacatagagcctactcacgcgcctttcatagagaaatcccgcagcggaggcaggaaatccctaagtca

SEQ ID NO: 7732 - DNA, 201 bp, Homo sapiens
tcagtcctggatgaggaaattgccaaggccaaggtagtggcagagcagatgagtcgtctgacaccagagcgaaatctggatttggagcgctatcaggaaawaggctcccagctgcaggagcgttggcaccgagtcattgcccagctcgagattcgccaatctgagctagaaagtatccaggaagttctgggagattaccga

SEQ ID NO: 7733 - DNA, 201 bp, Homo sapiens
cacatgatacagcaaaaggagttcattgcaatactgtctttggatattgtttcagtactgggtgtttaaaggacaaatagctgctagaattcaggggtaartgtaagtgttcagaaaacgtcagaacatttggggttttaaactgatttgttgctccctatccagcctagacaccagtaactcttgtgttcaccaggaccc

SEQ ID NO: 7734 - DNA, 201 bp, Homo sapiens
ttacggcactggcttagtgatgtgaaggacaagaattcagtgttttcagtcctggatgaggaaattgccaaggccaaggtagtggcagagcagatgagtcrtctgacaccagagcgaaatctggatttggagcgctatcaggaaaaaggctcccagctgcaggagcgttggcaccgagtcattgcccagctcgagattcgc

SEQ ID NO: 7735 - DNA, 201 bp, Homo sapiens
actcaattcagagcgttatgcccgcctagagcgggcccaggtcttagtaaaccagttttgggaaacttatgaagagctcagcccctggattgaggaaactygggcactaatagcacagttaccctctccagccattgatcatgagcagctcaggcagcaacaagaggaaatgaggcaattaagggaatctattgctgaaca

SEQ ID NO: 7736 - DNA, 201 bp, Homo sapiens
aaggagtttcagaagactcttggtggcaagcagcctgtgtatgataccacaattagaactggcagagcactgaaagaaaagactttgcttcccgaagatastcagaaacttgacaatttcctaggagaagtcagagacaaatgggatactgtttgtggcaagtctgtggagcggcagcacaagttggaggaagccctgctc

SEQ ID NO: 7737 - DNA, 201 bp, Homo sapiens
ggaacagataccccagtttcagcagagacagaaggaattaaagaaggaggtcatggagcacaggctggtgttggacacagtgaatgaggtgagccgtgctstcttagagctggtgccctggagagccagagaagggctggataaacttgtgtccgatgctaacgagcagtacaaactagtcagtgacactattggacaaag

SEQ ID NO: 7738 - DNA, 201 bp, Homo sapiens; identical to SEQ ID NO: 7728

SEQ ID NO: 7739 - DNA, 201 bp, Homo sapiens; identical to SEQ ID NO: 7713

SEQ ID NO: 7740 - DNA, 201 bp, Homo sapiens; identical to SEQ ID NO: 7731

SEQ ID NO: 7741 - DNA, 201 bp, Homo sapiens; identical to SEQ ID NO: 7715

SEQ ID NO: 7742 - DNA, 201 bp, Homo sapiens; identical to SEQ ID NO: 7705

SEQ ID NO: 7743 - DNA, 201 bp, Homo sapiens; identical to SEQ ID NO: 7733

SEQ ID NO: 7744 - DNA, 201 bp, Homo sapiens; identical to SEQ ID NO: 7708

SEQ ID NO: 7745 - DNA, 201 bp, Homo sapiens; identical to SEQ ID NO: 7709

SEQ ID NO: 7746 - DNA, 201 bp, Homo sapiens; identical to SEQ ID NO: 7712

SEQ ID NO: 7747 - DNA, 201 bp, Homo sapiens; identical to SEQ ID NO: 7711

SEQ ID NO: 7748 - DNA, 201 bp, Homo sapiens; identical to SEQ ID NO: 7736

SEQ ID NO: 7749 - DNA, 201 bp, Homo sapiens; identical to SEQ ID NO: 7720

SEQ ID NO: 7750 - DNA, 201 bp, Homo sapiens; identical to SEQ ID NO: 7735

SEQ ID NO: 7751 - DNA, 201 bp, Homo sapiens; identical to SEQ ID NO: 7721

SEQ ID NO: 7752 - DNA, 201 bp, Homo sapiens; identical to SEQ ID NO: 7737

SEQ ID NO: 7753 - DNA, 201 bp, Homo sapiens; identical to SEQ ID NO: 7691

SEQ ID NO: 7754 - DNA, 201 bp, Homo sapiens; identical to SEQ ID NO: 7692

SEQ ID NO: 7755 - DNA, 152 bp, Homo sapiens; identical to SEQ ID NO: 7693

SEQ ID NO: 7756 - DNA, 201 bp, Homo sapiens; identical to SEQ ID NO: 7694

SEQ ID NO: 7757 - DNA, 201 bp, Homo sapiens; identical to SEQ ID NO: 7695

SEQ ID NO: 7758 - DNA, 201 bp, Homo sapiens; identical to SEQ ID NO: 7696

SEQ ID NO: 7759 - DNA, 193 bp, Homo sapiens; identical to SEQ ID NO: 7697

SEQ ID NO: 7760 - DNA, 201 bp, Homo sapiens; identical to SEQ ID NO: 7698

SEQ ID NO: 7761 - DNA, 201 bp, Homo sapiens; identical to SEQ ID NO: 7699

SEQ ID NO: 7762 - DNA, 201 bp, Homo sapiens; identical to SEQ ID NO: 7700

SEQ ID NO: 7763 - DNA, 201 bp, Homo sapiens; identical to SEQ ID NO: 7701

SEQ ID NO: 7764 - DNA, 201 bp, Homo sapiens; identical to SEQ ID NO: 7702

SEQ ID NO: 7765 - DNA, 201 bp, Homo sapiens; identical to SEQ ID NO: 7703

SEQ ID NO: 7766 - DNA, 201 bp, Homo sapiens; identical to SEQ ID NO: 7704

SEQ ID NO: 7767 - DNA, 201 bp, Homo sapiens; identical to SEQ ID NO: 7705

SEQ ID NO: 7768 - DNA, 201 bp, Homo sapiens; identical to SEQ ID NO: 7706

SEQ ID NO: 7769 - DNA, 201 bp, Homo sapiens; identical to SEQ ID NO: 7707

SEQ ID NO: 7770 - DNA, 201 bp, Homo sapiens; identical to SEQ ID NO: 7708

SEQ ID NO: 7771 - DNA, 201 bp, Homo sapiens; identical to SEQ ID NO: 7709

SEQ ID NO: 7772 - DNA, 201 bp, Homo sapiens; identical to SEQ ID NO: 7710

SEQ ID NO: 7773 - DNA, 201 bp, Homo sapiens; identical to SEQ ID NO: 7711

SEQ ID NO: 7774 - DNA, 201 bp, Homo sapiens; identical to SEQ ID NO: 7712

SEQ ID NO: 7775 - DNA, 201 bp, Homo sapiens; identical to SEQ ID NO: 7713

SEQ ID NO: 7776 - DNA, 201 bp, Homo sapiens; identical to SEQ ID NO: 7714

SEQ ID NO: 7777 - DNA, 201 bp, Homo sapiens; identical to SEQ ID NO: 7715

SEQ ID NO: 7778 - DNA, 201 bp, Homo sapiens; identical to SEQ ID NO: 7716

SEQ ID NO: 7779 - DNA, 201 bp, Homo sapiens; identical to SEQ ID NO: 7717

SEQ ID NO: 7780 - DNA, 157 bp, Homo sapiens; identical to SEQ ID NO: 7718

SEQ ID NO: 7781 - DNA, 201 bp, Homo sapiens; identical to SEQ ID NO: 7719

SEQ ID NO: 7782 - DNA, 201 bp, Homo sapiens; identical to SEQ ID NO: 7720

SEQ ID NO: 7783 - DNA, 201 bp, Homo sapiens; identical to SEQ ID NO: 7721

SEQ ID NO: 7784 - DNA, 201 bp, Homo sapiens; identical to SEQ ID NO: 7722

SEQ ID NO: 7785 - DNA, 201 bp, Homo sapiens; identical to SEQ ID NO: 7723

SEQ ID NO: 7786 - DNA, 201 bp, Homo sapiens; identical to SEQ ID NO: 7724

SEQ ID NO: 7787 - DNA, 201 bp, Homo sapiens; identical to SEQ ID NO: 7725

SEQ ID NO: 7788 - DNA, 201 bp, Homo sapiens; identical to SEQ ID NO: 7726

SEQ ID NO: 7789 - DNA, 201 bp, Homo sapiens; identical to SEQ ID NO: 7727

SEQ ID NO: 7790 - DNA, 201 bp, Homo sapiens; identical to SEQ ID NO: 7728

SEQ ID NO: 7791 - DNA, 201 bp, Homo sapiens; identical to SEQ ID NO: 7729

SEQ ID NO: 7792 - DNA, 201 bp, Homo sapiens; identical to SEQ ID NO: 7730

SEQ ID NO: 7793 - DNA, 201 bp, Homo sapiens; identical to SEQ ID NO: 7731

SEQ ID NO: 7794 - DNA, 201 bp, Homo sapiens; identical to SEQ ID NO: 7732

SEQ ID NO: 7795 - DNA, 201 bp, Homo sapiens; identical to SEQ ID NO: 7733

SEQ ID NO: 7796 - DNA, 201 bp, Homo sapiens; identical to SEQ ID NO: 7734

SEQ ID NO: 7797 - DNA, 201 bp, Homo sapiens; identical to SEQ ID NO: 7736

SEQ ID NO: 7798 - DNA, 201 bp, Homo sapiens; identical to SEQ ID NO: 7735

SEQ ID NO: 7799 - DNA, 201 bp, Homo sapiens; identical to SEQ ID NO: 7737

SEQ ID NO: 7800 - DNA, 201 bp, Homo sapiens; identical to SEQ ID NO: 7691

SEQ ID NO: 7801 - DNA, 201 bp, Homo sapiens; identical to SEQ ID NO: 7692

SEQ ID NO: 7802 - DNA, 152 bp, Homo sapiens; identical to SEQ ID NO: 7693

SEQ ID NO: 7803 - DNA, 201 bp, Homo sapiens; identical to SEQ ID NO: 7694

SEQ ID NO: 7804 - DNA, 201 bp, Homo sapiens; identical to SEQ ID NO: 7695

SEQ ID NO: 7805 - DNA, 201 bp, Homo sapiens; identical to SEQ ID NO: 7696

SEQ ID NO: 7806 - DNA, 193 bp, Homo sapiens; identical to SEQ ID NO: 7697

SEQ ID NO: 7807 - DNA, 201 bp, Homo sapiens; identical to SEQ ID NO: 7698

SEQ ID NO: 7808 - DNA, 201 bp, Homo sapiens; identical to SEQ ID NO: 7699

SEQ ID NO: 7809 - DNA, 201 bp, Homo sapiens; identical to SEQ ID NO: 7700

SEQ ID NO: 7810 - DNA, 201 bp, Homo sapiens; identical to SEQ ID NO: 7701

SEQ ID NO: 7811 - DNA, 201 bp, Homo sapiens; identical to SEQ ID NO: 7702

SEQ ID NO: 7812 - DNA, 201 bp, Homo sapiens; identical to SEQ ID NO: 7703

SEQ ID NO: 7813 - DNA, 201 bp, Homo sapiens; identical to SEQ ID NO: 7704

SEQ ID NO: 7814 - DNA, 201 bp, Homo sapiens; identical to SEQ ID NO: 7705

SEQ ID NO: 7815 - DNA, 201 bp, Homo sapiens; identical to SEQ ID NO: 7708

SEQ ID NO: 7816 - DNA, 201 bp, Homo sapiens; identical to SEQ ID NO: 7706

SEQ ID NO: 7817 - DNA, 201 bp, Homo sapiens; identical to SEQ ID NO: 7707

SEQ ID NO: 7818 - DNA, 201 bp, Homo sapiens; identical to SEQ ID NO: 7709

SEQ ID NO: 7819 - DNA, 201 bp, Homo sapiens; identical to SEQ ID NO: 7712

SEQ ID NO: 7820 - DNA, 201 bp, Homo sapiens; identical to SEQ ID NO: 7711

SEQ ID NO: 7821 - DNA, 201 bp, Homo sapiens; identical to SEQ ID NO: 7710

SEQ ID NO: 7822 - DNA, 201 bp, Homo sapiens; identical to SEQ ID NO: 7713

SEQ ID NO: 7823 - DNA, 201 bp, Homo sapiens; identical to SEQ ID NO: 7714

SEQ ID NO: 7824 - DNA, 201 bp, Homo sapiens; identical to SEQ ID NO: 7715

SEQ ID NO: 7825 - DNA, 201 bp, Homo sapiens; identical to SEQ ID NO: 7716

SEQ ID NO: 7826 - DNA, 201 bp, Homo sapiens; identical to SEQ ID NO: 7717

SEQ ID NO: 7827 - DNA, 157 bp, Homo sapiens; identical to SEQ ID NO: 7718

SEQ ID NO: 7828 - DNA, 201 bp, Homo sapiens; identical to SEQ ID NO: 7719

SEQ ID NO: 7829 - DNA, 201 bp, Homo sapiens; identical to SEQ ID NO: 7720

SEQ ID NO: 7830 - DNA, 201 bp, Homo sapiens; identical to SEQ ID NO: 7721

SEQ ID NO: 7831 - DNA, 201 bp, Homo sapiens; identical to SEQ ID NO: 7722

SEQ ID NO: 7832 - DNA, 201 bp, Homo sapiens; identical to SEQ ID NO: 7723

SEQ ID NO: 7833 - DNA, 201 bp, Homo sapiens; identical to SEQ ID NO: 7724

SEQ ID NO: 7834 - DNA, 201 bp, Homo sapiens; identical to SEQ ID NO: 7725

SEQ ID NO: 7835 - DNA, 201 bp, Homo sapiens; identical to SEQ ID NO: 7726

SEQ ID NO: 7836 - DNA, 201 bp, Homo sapiens
aaactgaagggagtattccacctacggaaacttctatgagtgctaaagagttagaaaagcagattgaacacctgaagagtctactagatgactgggcaagyaagggaactctggtggaagaaatcaattgcaaaggtacttctttagaaaatctcatcatggaaatcacagcacctgattcccaaggcaagacagatctga

SEQ ID NO: 7837 - DNA, 201 bp, Homo sapiens; identical to SEQ ID NO: 7728

SEQ ID NO: 7838 - DNA, 201 bp, Homo sapiens; identical to SEQ ID NO: 7729

SEQ ID NO: 7839 - DNA, 201 bp, Homo sapiens; identical to SEQ ID NO: 7730

SEQ ID NO: 7840 - DNA, 201 bp, Homo sapiens; identical to SEQ ID NO: 7731

SEQ ID NO: 7841 - DNA, 201 bp, Homo sapiens; identical to SEQ ID NO: 7732

SEQ ID NO: 7842 - DNA, 201 bp, Homo sapiens; identical to SEQ ID NO: 7733

SEQ ID NO: 7843 - DNA, 201 bp, Homo sapiens; identical to SEQ ID NO: 7734

SEQ ID NO: 7844 - DNA, 201 bp, Homo sapiens; identical to SEQ ID NO: 7735

SEQ ID NO: 7845 - DNA, 201 bp, Homo sapiens; identical to SEQ ID NO: 7736

SEQ ID NO: 7846 - DNA, 201 bp, Homo sapiens; identical to SEQ ID NO: 7737

SEQ ID NO: 7847 - DNA, 201 bp, Homo sapiens; identical to SEQ ID NO: 7691

SEQ ID NO: 7848 - DNA, 201 bp, Homo sapiens; identical to SEQ ID NO: 7692

SEQ ID NO: 7849 - DNA, 152 bp, Homo sapiens; identical to SEQ ID NO: 7693

SEQ ID NO: 7850 - DNA, 201 bp, Homo sapiens; identical to SEQ ID NO: 7694

SEQ ID NO: 7851 - DNA, 201 bp, Homo sapiens; identical to SEQ ID NO: 7695

SEQ ID NO: 7852 - DNA, 201 bp, Homo sapiens; identical to SEQ ID NO: 7696

SEQ ID NO: 7853 - DNA, 193 bp, Homo sapiens; identical to SEQ ID NO: 7697

SEQ ID NO: 7854 - DNA, 201 bp, Homo sapiens; identical to SEQ ID NO: 7698

SEQ ID NO: 7855 - DNA, 201 bp, Homo sapiens; identical to SEQ ID NO: 7699

SEQ ID NO: 7856 - DNA, 201 bp, Homo sapiens; identical to SEQ ID NO: 7700

SEQ ID NO: 7857 - DNA, 201 bp, Homo sapiens; identical to SEQ ID NO: 7701

SEQ ID NO: 7858 - DNA, 201 bp, Homo sapiens; identical to SEQ ID NO: 7702

SEQ ID NO: 7859 - DNA, 201 bp, Homo sapiens; identical to SEQ ID NO: 7703

SEQ ID NO: 7860 - DNA, 201 bp, Homo sapiens; identical to SEQ ID NO: 7704

SEQ ID NO: 7861 - DNA, 201 bp, Homo sapiens; identical to SEQ ID NO: 7705

SEQ ID NO: 7862 - DNA, 201 bp, Homo sapiens; identical to SEQ ID NO: 7708

SEQ ID NO: 7863 - DNA, 201 bp, Homo sapiens; identical to SEQ ID NO: 7706

SEQ ID NO: 7864 - DNA, 201 bp, Homo sapiens; identical to SEQ ID NO: 7707

SEQ ID NO: 7865 - DNA, 201 bp, Homo sapiens; identical to SEQ ID NO: 7709

SEQ ID NO: 7866 - DNA, 201 bp, Homo sapiens; identical to SEQ ID NO: 7712

SEQ ID NO: 7867 - DNA, 201 bp, Homo sapiens; identical to SEQ ID NO: 7711

SEQ ID NO: 7868 - DNA, 201 bp, Homo sapiens; identical to SEQ ID NO: 7710

SEQ ID NO: 7869 - DNA, 201 bp, Homo sapiens; identical to SEQ ID NO: 7713

SEQ ID NO: 7870 - DNA, 201 bp, Homo sapiens; identical to SEQ ID NO: 7714

SEQ ID NO: 7871 - DNA, 201 bp, Homo sapiens; identical to SEQ ID NO: 7715

SEQ ID NO: 7872 - DNA, 201 bp, Homo sapiens; identical to SEQ ID NO: 7716

SEQ ID NO: 7873 - DNA, 201 bp, Homo sapiens; identical to SEQ ID NO: 7717

SEQ ID NO: 7874 - DNA, 157 bp, Homo sapiens; identical to SEQ ID NO: 7718

SEQ ID NO: 7875 - DNA, 201 bp, Homo sapiens; identical to SEQ ID NO: 7719

SEQ ID NO: 7876 - DNA, 201 bp, Homo sapiens; identical to SEQ ID NO: 7720

SEQ ID NO: 7877 - DNA, 201 bp, Homo sapiens; identical to SEQ ID NO: 7721

SEQ ID NO: 7878 - DNA, 201 bp, Homo sapiens; identical to SEQ ID NO: 7722

SEQ ID NO: 7879 - DNA, 201 bp, Homo sapiens; identical to SEQ ID NO: 7723

SEQ ID NO: 7880 - DNA, 201 bp, Homo sapiens; identical to SEQ ID NO: 7724

SEQ ID NO: 7881 - DNA, 201 bp, Homo sapiens; identical to SEQ ID NO: 7725

SEQ ID NO: 7882 - DNA, 201 bp, Homo sapiens; identical to SEQ ID NO: 7726

SEQ ID NO: 7883 - DNA, 201 bp, Homo sapiens; identical to SEQ ID NO: 7727

SEQ ID NO: 7884 - DNA, 201 bp, Homo sapiens; identical to SEQ ID NO: 7728

SEQ ID NO: 7885 - DNA, 201 bp, Homo sapiens; identical to SEQ ID NO: 7729

SEQ ID NO: 7886 - DNA, 201 bp, Homo sapiens; identical to SEQ ID NO: 7730

SEQ ID NO: 7887 - DNA, 201 bp, Homo sapiens; identical to SEQ ID NO: 7731

SEQ ID NO: 7888 - DNA, 201 bp, Homo sapiens; identical to SEQ ID NO: 7732

SEQ ID NO: 7889 - DNA, 201 bp, Homo sapiens; identical to SEQ ID NO: 7733

SEQ ID NO: 7890 - DNA, 201 bp, Homo sapiens; identical to SEQ ID NO: 7734

SEQ ID NO: 7891 - DNA, 201 bp, Homo sapiens; identical to SEQ ID NO: 7735

SEQ ID NO: 7892 - DNA, 201 bp, Homo sapiens; identical to SEQ ID NO: 7736

SEQ ID NO: 7893 - DNA, 201 bp, Homo sapiens; identical to SEQ ID NO: 7737

SEQ ID NO: 7894 - DNA, 201 bp, Homo sapiens; identical to SEQ ID NO: 7691

SEQ ID NO: 7895 - DNA, 201 bp, Homo sapiens; identical to SEQ ID NO: 7692

SEQ ID NO: 7896 - DNA, 201 bp, Homo sapiens; identical to SEQ ID NO: 7694

SEQ ID NO: 7897 - DNA, 201 bp, Homo sapiens; identical to SEQ ID NO: 7695

SEQ ID NO: 7898 - DNA, 201 bp, Homo sapiens; identical to SEQ ID NO: 7696

SEQ ID NO: 7899 - DNA, 201 bp, Homo sapiens; identical to SEQ ID NO: 7698

SEQ ID NO: 7900 - DNA, 201 bp, Homo sapiens; identical to SEQ ID NO: 7699

SEQ ID NO: 7901 - DNA, 201 bp, Homo sapiens; identical to SEQ ID NO: 7700

SEQ ID NO: 7902 - DNA, 201 bp, Homo sapiens; identical to SEQ ID NO: 7701

SEQ ID NO: 7903 - DNA, 201 bp, Homo sapiens; identical to SEQ ID NO: 7703

SEQ ID NO: 7904 - DNA, 201 bp, Homo sapiens; identical to SEQ ID NO: 7704

SEQ ID NO: 7905 - DNA, 201 bp, Homo sapiens; identical to SEQ ID NO: 7705

SEQ ID NO: 7906 - DNA, 201 bp, Homo sapiens; identical to SEQ ID NO: 7708

SEQ ID NO: 7907 - DNA, 201 bp, Homo sapiens; identical to SEQ ID NO: 7706

SEQ ID NO: 7908 - DNA, 201 bp, Homo sapiens; identical to SEQ ID NO: 7707

SEQ ID NO: 7909 - DNA, 201 bp, Homo sapiens; identical to SEQ ID NO: 7709

SEQ ID NO: 7910 - DNA, 201 bp, Homo sapiens; identical to SEQ ID NO: 7712

SEQ ID NO: 7911 - DNA, 201 bp, Homo sapiens; identical to SEQ ID NO: 7711

SEQ ID NO: 7912 - DNA, 201 bp, Homo sapiens; identical to SEQ ID NO: 7713

SEQ ID NO: 7913 - DNA, 201 bp, Homo sapiens
gccgacttcaagatctgagagcctgggttggcaataaaaatcttattctgaacagcaagggatctaacagtgaaatagatgttgacagcctgaacctctgyctccaacagtatgaggatttgaaacagcccatggctgaaaggaaagctcagctggatgctcttgcttttgatattcagttctttatctcagaacatgccc

SEQ ID NO: 7914 - DNA, 201 bp, Homo sapiens; identical to SEQ ID NO: 7715

SEQ ID NO: 7915 - DNA, 201 bp, Homo sapiens
gagaaagcttccaaaggtagagatgctgaaaaaacagttagggagagattaattagtttacaaatggaaacaacaggacttatagaccctgatagtaaagsacctttaacagttgtgcagtccattgacagaggtcttttggagagagaggaggccgttcgtttgttgactaagcaagtggtagatggaggtatcattcac

SEQ ID NO: 7916 - DNA, 201 bp, Homo sapiens
gtgaaaatctcaggaactttcagcagtgggtggactgtgaggctgcctgagttccagttttcttctcagaacaaagaatatcccgatcgggaagattgcaytacagaaaaaggcaaaaagaccactgtagaaacagaagattcttctgtagagaaccctgaacaggatctgtttgtagaacaaaaagagagaaatccaaac

SEQ ID NO: 7917 - DNA, 201 bp, Homo sapiens; identical to SEQ ID NO: 7719

SEQ ID NO: 7918 - DNA, 201 bp, Homo sapiens; identical to SEQ ID NO: 7720

SEQ ID NO: 7919 - DNA, 201 bp, Homo sapiens; identical to SEQ ID NO: 7721

SEQ ID NO: 7920 - DNA, 201 bp, Homo sapiens
tggcctgtgctatcctcataaggcagcttcagacaggaggcatcatagacactgtcacggggcaaaggctaacaatagatgaagcagtgagcaatgatctrgtagctgctaagatcgcccttgtgattctggagtccctctggtcattcatggggttgctgtggcctgaatctggagagatcctcccaattacagatgccc

SEQ ID NO: 7921 - DNA, 201 bp, Homo sapiens; identical to SEQ ID NO: 7723

SEQ ID NO: 7922 - DNA, 201 bp, Homo sapiens; identical to SEQ ID NO: 7724

SEQ ID NO: 7923 - DNA, 201 bp, Homo sapiens; identical to SEQ ID NO: 7725

SEQ ID NO: 7924 - DNA, 201 bp, Homo sapiens; identical to SEQ ID NO: 7726

SEQ ID NO: 7925 - DNA, 201 bp, Homo sapiens
cagaacatgcccaggacttgtcccctcagcagaatcgacagatgctgaggcttctgaatgaactgcagaggtccttccaggacattttggaacagactgcmgctcaggtggatgccttgcagggccatcttcaacaaatggagcaggaagccctggtgaagaccctgcagaaacaacaaaatacctgtcaccagcaactgg

SEQ ID NO: 7926 - DNA, 201 bp, Homo sapiens
atttctagaaatggcaaaccctaatgttgcaggtctagaagcaggatccattgaggacatagtgactcagagaggttccagagtcttgggatcctttcttycagagaaactgttcaaaggagtgtctcaaaaagagaatacagggcaacagaatgccatcattagtcctactgttctagagaccagtgaagaaaagacagt

SEQ ID NO: 7927 - DNA, 201 bp, Homo sapiens; identical to SEQ ID NO: 7727

SEQ ID NO: 7928 - DNA, 201 bp, Homo sapiens; identical to SEQ ID NO: 7728

SEQ ID NO: 7929 - DNA, 201 bp, Homo sapiens; identical to SEQ ID NO: 7729

SEQ ID NO: 7930 - DNA, 201 bp, Homo sapiens; identical to SEQ ID NO: 7730

SEQ ID NO: 7931 - DNA, 201 bp, Homo sapiens; identical to SEQ ID NO: 7731

SEQ ID NO: 7932 - DNA, 201 bp, Homo sapiens; identical to SEQ ID NO: 7733

SEQ ID NO: 7933 - DNA, 201 bp, Homo sapiens; identical to SEQ ID NO: 7735

SEQ ID NO: 7934 - DNA, 201 bp, Homo sapiens; identical to SEQ ID NO: 7736

SEQ ID NO: 7935 - DNA, 201 bp, Homo sapiens; identical to SEQ ID NO: 7737

SEQ ID NO: 7936 - DNA, 201 bp, Homo sapiens; identical to SEQ ID NO: 7691

SEQ ID NO: 7937 - DNA, 201 bp, Homo sapiens; identical to SEQ ID NO: 7692

SEQ ID NO: 7938 - DNA, 201 bp, Homo sapiens; identical to SEQ ID NO: 7694

SEQ ID NO: 7939 - DNA, 201 bp, Homo sapiens; identical to SEQ ID NO: 7695

SEQ ID NO: 7940 - DNA, 201 bp, Homo sapiens; identical to SEQ ID NO: 7696

SEQ ID NO: 7941 - DNA, 201 bp, Homo sapiens; identical to SEQ ID NO: 7698

SEQ ID NO: 7942 - DNA, 201 bp, Homo sapiens; identical to SEQ ID NO: 7699

SEQ ID NO: 7943 - DNA, 201 bp, Homo sapiens; identical to SEQ ID NO: 7700

SEQ ID NO: 7944 - DNA, 201 bp, Homo sapiens; identical to SEQ ID NO: 7701

SEQ ID NO: 7945 - DNA, 201 bp, Homo sapiens; identical to SEQ ID NO: 7702

SEQ ID NO: 7946 - DNA, 201 bp, Homo sapiens; identical to SEQ ID NO: 7703

SEQ ID NO: 7947 - DNA, 201 bp, Homo sapiens; identical to SEQ ID NO: 7704

SEQ ID NO: 7948 - DNA, 201 bp, Homo sapiens; identical to SEQ ID NO: 7705

SEQ ID NO: 7949 - DNA, 201 bp, Homo sapiens; identical to SEQ ID NO: 7708

SEQ ID NO: 7950 - DNA, 201 bp, Homo sapiens; identical to SEQ ID NO: 7706

SEQ ID NO: 7951 - DNA, 201 bp, Homo sapiens; identical to SEQ ID NO: 7707

SEQ ID NO: 7952 - DNA, 201 bp, Homo sapiens; identical to SEQ ID NO: 7709

SEQ ID NO: 7953 - DNA, 201 bp, Homo sapiens; identical to SEQ ID NO: 7712

SEQ ID NO: 7954 - DNA, 201 bp, Homo sapiens; identical to SEQ ID NO: 7711

SEQ ID NO: 7955 - DNA, 201 bp, Homo sapiens; identical to SEQ ID NO: 7710

SEQ ID NO: 7956 - DNA, 201 bp, Homo sapiens; identical to SEQ ID NO: 7713

SEQ ID NO: 7957 - DNA, 201 bp, Homo sapiens; identical to SEQ ID NO: 7714

SEQ ID NO: 7958 - DNA, 201 bp, Homo sapiens; identical to SEQ ID NO: 7715

SEQ ID NO: 7959 - DNA, 201 bp, Homo sapiens; identical to SEQ ID NO: 7716

SEQ ID NO: 7960 - DNA, 201 bp, Homo sapiens; identical to SEQ ID NO: 7717

SEQ ID NO: 7961 - DNA, 201 bp, Homo sapiens; identical to SEQ ID NO: 7719

SEQ ID NO: 7962 - DNA, 201 bp, Homo sapiens; identical to SEQ ID NO: 7720

SEQ ID NO: 7963 - DNA, 201 bp, Homo sapiens; identical to SEQ ID NO: 7721

SEQ ID NO: 7964 - DNA, 201 bp, Homo sapiens; identical to SEQ ID NO: 7722

SEQ ID NO: 7965 - DNA, 201 bp, Homo sapiens; identical to SEQ ID NO: 7723

SEQ ID NO: 7966 - DNA, 201 bp, Homo sapiens; identical to SEQ ID NO: 7724

SEQ ID NO: 7967 - DNA, 201 bp, Homo sapiens; identical to SEQ ID NO: 7725

SEQ ID NO: 7968 - DNA, 201 bp, Homo sapiens; identical to SEQ ID NO: 7726

SEQ ID NO: 7969 - DNA, 201 bp, Homo sapiens; identical to SEQ ID NO: 7727

SEQ ID NO: 7970 - DNA, 201 bp, Homo sapiens; identical to SEQ ID NO: 7728

SEQ ID NO: 7971 - DNA, 201 bp, Homo sapiens; identical to SEQ ID NO: 7729

SEQ ID NO: 7972 - DNA, 201 bp, Homo sapiens; identical to SEQ ID NO: 7730

SEQ ID NO: 7973 - DNA, 201 bp, Homo sapiens; identical to SEQ ID NO: 7731

SEQ ID NO: 7974 - DNA, 201 bp, Homo sapiens; identical to SEQ ID NO: 7732

SEQ ID NO: 7975 - DNA, 201 bp, Homo sapiens; identical to SEQ ID NO: 7733

SEQ ID NO: 7976 - DNA, 201 bp, Homo sapiens; identical to SEQ ID NO: 7734

SEQ ID NO: 7977 - DNA, 201 bp, Homo sapiens; identical to SEQ ID NO: 7735

SEQ ID NO: 7978 - DNA, 201 bp, Homo sapiens; identical to SEQ ID NO: 7736

SEQ ID NO: 7979 - DNA, 201 bp, Homo sapiens; identical to SEQ ID NO: 7737

SEQ ID NO: 7980 - DNA, 201 bp, Homo sapiens; identical to SEQ ID NO: 7691

SEQ ID NO: 7981 - DNA, 201 bp, Homo sapiens; identical to SEQ ID NO: 7692

SEQ ID NO: 7982 - DNA, 152 bp, Homo sapiens; identical to SEQ ID NO: 7693

SEQ ID NO: 7983 - DNA, 201 bp, Homo sapiens; identical to SEQ ID NO: 7694

SEQ ID NO: 7984 - DNA, 201 bp, Homo sapiens; identical to SEQ ID NO: 7695

SEQ ID NO: 7985 - DNA, 201 bp, Homo sapiens; identical to SEQ ID NO: 7696

SEQ ID NO: 7986 - DNA, 193 bp, Homo sapiens; identical to SEQ ID NO: 7697

SEQ ID NO: 7987 - DNA, 201 bp, Homo sapiens; identical to SEQ ID NO: 7698

SEQ ID NO: 7988 - DNA, 201 bp, Homo sapiens; identical to SEQ ID NO: 7699

SEQ ID NO: 7989 - DNA, 201 bp, Homo sapiens; identical to SEQ ID NO: 7723

SEQ ID NO: 7990 - DNA, 201 bp, Homo sapiens; identical to SEQ ID NO: 7701

SEQ ID NO: 7991 - DNA, 201 bp, Homo sapiens; identical to SEQ ID NO: 7703

SEQ ID NO: 7992 - DNA, 201 bp, Homo sapiens; identical to SEQ ID NO: 7702

SEQ ID NO: 7993 - DNA, 201 bp, Homo sapiens; identical to SEQ ID NO: 7705

SEQ ID NO: 7994 - DNA, 201 bp, Homo sapiens; identical to SEQ ID NO: 7706

SEQ ID NO: 7995 - DNA, 201 bp, Homo sapiens; identical to SEQ ID NO: 7707

SEQ ID NO: 7996 - DNA, 201 bp, Homo sapiens; identical to SEQ ID NO: 7708

SEQ ID NO: 7997 - DNA, 201 bp, Homo sapiens
ggctcatcaagccacagtggaaacagtcaacaaagctggcaatgagcttcttgaatccagtgctggagatgatgccagcagcttaaggagccgtttggaarccatgaaccaatgctgggagtcagtgttacagaaaacagaggagagggagcagcagcttcagtcaactctgcagcaggtacatgtgacatccaatgaaat

SEQ ID NO: 7998 - DNA, 201 bp, Homo sapiens; identical to SEQ ID NO: 7711

SEQ ID NO: 7999 - DNA, 201 bp, Homo sapiens; identical to SEQ ID NO: 7712

SEQ ID NO: 8000 - DNA, 201 bp, Homo sapiens; identical to SEQ ID NO: 7728

SEQ ID NO: 8001 - DNA, 201 bp, Homo sapiens; identical to SEQ ID NO: 7729

SEQ ID NO: 8002 - DNA, 201 bp, Homo sapiens; identical to SEQ ID NO: 7713

SEQ ID NO: 8003 - DNA, 201 bp, Homo sapiens; identical to SEQ ID NO: 7715

SEQ ID NO: 8004 - DNA, 201 bp, Homo sapiens
gcgggatcaggagccaatcccgcagaacattgaccgagttaaagcccttatcgctgagcatcagacatttatggaggagatgactcgcaaacagcctgacrtggaccgggtcaccaagacatacaaaaggaaaaacatagagcctactcacgcgcctttcatagagaaatcccgcagcggaggcattgaaagaatttgcca

SEQ ID NO: 8005 - DNA, 157 bp, Homo sapiens; identical to SEQ ID NO: 7718

SEQ ID NO: 8006 - DNA, 201 bp, Homo sapiens; identical to SEQ ID NO: 7733

SEQ ID NO: 8007 - DNA, 201 bp, Homo sapiens; identical to SEQ ID NO: 7720

SEQ ID NO: 8008 - DNA, 201 bp, Homo sapiens; identical to SEQ ID NO: 7736

SEQ ID NO: 8009 - DNA, 201 bp, Homo sapiens; identical to SEQ ID NO: 7735

SEQ ID NO: 8010 - DNA, 201 bp, Homo sapiens; identical to SEQ ID NO: 7737

SEQ ID NO: 8011 - DNA, 201 bp, Homo sapiens; identical to SEQ ID NO: 7721

SEQ ID NO: 8012 - DNA, 201 bp, Homo sapiens; identical to SEQ ID NO: 7691

SEQ ID NO: 8013 - DNA, 201 bp, Homo sapiens; identical to SEQ ID NO: 7692

SEQ ID NO: 8014 - DNA, 152 bp, Homo sapiens; identical to SEQ ID NO: 7693

SEQ ID NO: 8015 - DNA, 201 bp, Homo sapiens; identical to SEQ ID NO: 7694

SEQ ID NO: 8016 - DNA, 201 bp, Homo sapiens; identical to SEQ ID NO: 7695

SEQ ID NO: 8017 - DNA, 201 bp, Homo sapiens; identical to SEQ ID NO: 7696

SEQ ID NO: 8018 - DNA, 193 bp, Homo sapiens; identical to SEQ ID NO: 7697

SEQ ID NO: 8019 - DNA, 201 bp, Homo sapiens; identical to SEQ ID NO: 7698

SEQ ID NO: 8020 - DNA, 201 bp, Homo sapiens; identical to SEQ ID NO: 7699

SEQ ID NO: 8021 - DNA, 201 bp, Homo sapiens; identical to SEQ ID NO: 7700

SEQ ID NO: 8022 - DNA, 201 bp, Homo sapiens; identical to SEQ ID NO: 7701

SEQ ID NO: 8023 - DNA, 201 bp, Homo sapiens; identical to SEQ ID NO: 7702

SEQ ID NO: 8024 - DNA, 201 bp, Homo sapiens; identical to SEQ ID NO: 7703

SEQ ID NO: 8025 - DNA, 201 bp, Homo sapiens; identical to SEQ ID NO: 7704

SEQ ID NO: 8026 - DNA, 201 bp, Homo sapiens; identical to SEQ ID NO: 7705

SEQ ID NO: 8027 - DNA, 201 bp, Homo sapiens; identical to SEQ ID NO: 7708

SEQ ID NO: 8028 - DNA, 201 bp, Homo sapiens; identical to SEQ ID NO: 7706

SEQ ID NO: 8029 - DNA, 201 bp, Homo sapiens; identical to SEQ ID NO: 7707

SEQ ID NO: 8030 - DNA, 201 bp, Homo sapiens; identical to SEQ ID NO: 7709

SEQ ID NO: 8031 - DNA, 201 bp, Homo sapiens; identical to SEQ ID NO: 7712

SEQ ID NO: 8032 - DNA, 201 bp, Homo sapiens; identical to SEQ ID NO: 7711

SEQ ID NO: 8033 - DNA, 201 bp, Homo sapiens; identical to SEQ ID NO: 7710

SEQ ID NO: 8034 - DNA, 201 bp, Homo sapiens; identical to SEQ ID NO: 7713

SEQ ID NO: 8035 - DNA, 201 bp, Homo sapiens; identical to SEQ ID NO: 7714

SEQ ID NO: 8036 - DNA, 201 bp, Homo sapiens; identical to SEQ ID NO: 7715

SEQ ID NO: 8037 - DNA, 201 bp, Homo sapiens; identical to SEQ ID NO: 7716

SEQ ID NO: 8038 - DNA, 201 bp, Homo sapiens; identical to SEQ ID NO: 7717

SEQ ID NO: 8039 - DNA, 157 bp, Homo sapiens; identical to SEQ ID NO: 7718

SEQ ID NO: 8040 - DNA, 201 bp, Homo sapiens; identical to SEQ ID NO: 7719

SEQ ID NO: 8041 - DNA, 201 bp, Homo sapiens; identical to SEQ ID NO: 7720

SEQ ID NO: 8042 - DNA, 201 bp, Homo sapiens
tcccatcatcaggtagcaagttgaaacgaccaacaccaacttttcattctagtcggacatcccttgctggtgataccagcaatagttcttccccggcctcyacaggtgccaaaactaatcgggcaggtaagtacctgccccgtgacctacaagccaggctgagaatttggaaacaacagcctatgtggaatgtttcactgc

SEQ ID NO: 8043 - DNA, 201 bp, Homo sapiens; identical to SEQ ID NO: 7722

SEQ ID NO: 8044 - DNA, 201 bp, Homo sapiens; identical to SEQ ID NO: 7723

SEQ ID NO: 8045 - DNA, 201 bp, Homo sapiens; identical to SEQ ID NO: 7724

SEQ ID NO: 8046 - DNA, 201 bp, Homo sapiens; identical to SEQ ID NO: 7725

SEQ ID NO: 8047 - DNA, 201 bp, Homo sapiens; identical to SEQ ID NO: 7726

SEQ ID NO: 8048 - DNA, 201 bp, Homo sapiens; identical to SEQ ID NO: 7727

SEQ ID NO: 8049 - DNA, 201 bp, Homo sapiens; identical to SEQ ID NO: 7728

SEQ ID NO: 8050 - DNA, 201 bp, Homo sapiens; identical to SEQ ID NO: 7729

SEQ ID NO: 8051 - DNA, 201 bp, Homo sapiens; identical to SEQ ID NO: 7730

SEQ ID NO: 8052 - DNA, 201 bp, Homo sapiens; identical to SEQ ID NO: 7731

SEQ ID NO: 8053 - DNA, 201 bp, Homo sapiens; identical to SEQ ID NO: 7732

SEQ ID NO: 8054 - DNA, 201 bp, Homo sapiens; identical to SEQ ID NO: 7734

SEQ ID NO: 8055 - DNA, 201 bp, Homo sapiens; identical to SEQ ID NO: 7735

SEQ ID NO: 8056 - DNA, 201 bp, Homo sapiens; identical to SEQ ID NO: 7736

SEQ ID NO: 8057 - DNA, 201 bp, Homo sapiens; identical to SEQ ID NO: 7737

SEQ ID NO: 8058 - DNA, 201 bp, Homo sapiens
cagacctgcctttggggggcgtgcatgtgttggtgctgacctccaggccgagatgtgcaacactcaggcctgcgagaagacccagctggagttcatgtcgsaacagtgcgccaggaccgacggccagccgctgcgctcctcccctggcggcgcctccttctaccactggggtgctgctgtaccacacagccaaggggatgc

SEQ ID NO: 8059 - DNA, 201 bp, Homo sapiens
gccagcagccaccagcgtggccagaggcctgcgtgctcgaaccctgccctccctactgggcggtgggagacttcggcccatgcagcgcctcctgtgggggyggcctgcgggagcggccagtgcgctgcgtggaggcccagggcagcctcctgaagacattgcccccagcccggtgcagagcaggggcccagcagccagctg

SEQ ID NO: 8060 - DNA, 201 bp, Homo sapiens
cccaggaggcctgcagcctggagccctgcccacctaggtggaaagtcatgtcccttggcccatgttcggccagctgtggccttggcactgctagacgctcrgtggcctgtgtgcagctcgaccaaggccaggacgtggaggtggacgaggcggcctgtgcggcgctggtgcggcccgaggccagtgtcccctgtctcattg

SEQ ID NO: 8061 - DNA, 201 bp, Homo sapiens
agcaggtgctctactgggagtcagagagcagccaggctgagatggagttcagcgagggcttcctgaaggctcaggccagcctgcggggccagtactggacmctccaatcatgggtaccggagatgcaggaccctcagtcctggaagggaaaggaaggaacctgagggtcattgaacatttgttccgtgtctggccagccct

SEQ ID NO: 8062 - DNA, 201 bp, Homo sapiens
tcgcccggaaccccaggaggcctgcagcctggagccctgcccacctaggtggaaagtcatgtcccttggcccatgttcggccagctgtggccttggcactrctagacgctcggtggcctgtgtgcagctcgaccaaggccaggacgtggaggtggacgaggcggcctgtgcggcgctggtgcggcccgaggccagtgtccc

SEQ ID NO: 8063 - DNA, 201 bp, Homo sapiens
agctgtggccttggcactgctagacgctcggtggcctgtgtgcagctcgaccaaggccaggacgtggaggtggacgaggcggcctgtgcggcgctggtgcrgcccgaggccagtgtcccctgtctcattgccgactgcacctaccgctggcatgttggcacctggatggagtgctctgtttcctgtggggatggcatccag

SEQ ID NO: 8064 - DNA, 201 bp, Homo sapiens
ctgcaacccccagccctgccctgccaggtgggaggtgtcagagcccagctcatgcacatcagctggtggagcaggcctggccttggagaacgagacctgtrtgccaggggcagatggcctggaggctccagtgactgaggggcctggctccgtagatgagaagctgcctgcccctgagccctgtgtcgggatgtcatgtcc

SEQ ID NO: 8065 - DNA, 201 bp, Homo sapiens
ccctggcttccagaggcagaggcagaggcagaggcgggctgcaggcggcatcctacacctggagctgctggtggccgtgggccccgatgtcttccaggctsaccaggaggacacagagcgctatgtgctcaccaacctcaacatcggggcagaactgcttcgggacccgtccctgggggctcagtttcgggtgcacctggt

SEQ ID NO: 8066 - DNA, 192 bp, Homo sapiens
tggagggttgacccctggtctcagtgctttccaattcgaactttttccaatcttaggtatctactttagagtcttctccaatgtccaaaaggctagggggytggaggtggggactctggaaaagcagcccccatttcctcgggtaccaataaataaaacatgcaggctgaccggcgtttttttcttataagc

SEQ ID NO: 8067 - DNA, 201 bp, Homo sapiens
cctgaggacgacacggatcctggccatgctgacctggtcctctatatcactaggtttgacctggagttgcctgatggtaaccggcaggtgcggggcgtcayccagctgggcggtgcctgctccccaacctggagctgcctcattaccgaggacactggcttcgacctgggagtcaccattgcccatgagattgggcacagc

SEQ ID NO: 8068 - DNA, 201 bp, Homo sapiens
cgacggcgcgcccggcagcggctgcggccccagcggacacgtgatggcttcggaacggcgccgccccgcgccggcctcgcctggtccccctgcagccgccsgcagctgctgagcctgctcagcgccaacgagcagtgccgcgtggccttcggccccaaggctgtcgcctgcaccttcgccagggagcacctggatatgtgc

SEQ ID NO: 8069 - DNA, 201 bp, Homo sapiens
ttcacacacttggcggtgaggatcggagggcgctatgtcgtggctgggaagatgagcatctcccctaacaccacctacccctccctcctggaggatggtcrtgtcgagtacagagtggccctcaccgaggaccggctgccccgcctggaggagatccgcatctggggacccctccaggaagatgctgacatccaggtttac

SEQ ID NO: 8070 - DNA, 201 bp, Homo sapiens
tggtgctccaagggtcgctgccgctccctggtggagctgacccccatagcagcagtgcatgggcgctggtctagctggggtccccgaagtccttgctcccrctcctgcggaggaggtgtggtcaccaggaggcggcagtgcaacaaccccagacctgcctttggggggcgtgcatgtgttggtgctgacctccaggccgag

SEQ ID NO: 8071 - DNA, 201 bp, Homo sapiens
agggcgctatgtcgtggctgggaagatgagcatctcccctaacaccacctacccctccctcctggaggatggtcgtgtcgagtacagagtggccctcaccraggaccggctgccccgcctggaggagatccgcatctggggacccctccaggaagatgctgacatccaggtttacaggcggtatggcgaggagtatggcaa

SEQ ID NO: 8072 - DNA, 201 bp, Homo sapiens
ccagctggagttcatgtcgcaacagtgcgccaggaccgacggccagccgctgcgctcctcccctggcggcgcctccttctaccactggggtgctgctgtaycacacagccaaggggatgctctgtgcagacacatgtgccgggccattggcgagagcttcatcatgaagcgtggagacagcttcctcgatgggacccggtg

SEQ ID NO: 8073 - DNA, 201 bp, Homo sapiens
ccacacagccaaggggatgctctgtgcagacacatgtgccgggccattggcgagagcttcatcatgaagcgtggagacagcttcctcgatgggacccggtrtatgccaagtggcccccgggaggacgggaccctgagcctgtgtgtgtcgggcagctgcaggacatttggctgtgatggtaggatggactcccagcaggta

SEQ ID NO: 8074 - DNA, 201 bp, Homo sapiens
gctctttgggccctggggtgaaatcgtgagcccctcgctgagtccagccacgagtaatgcagggggctgccggctcttcattaatgtggctccgcacgcayggattgccatccatgccctggccaccaacatgggcgctgggaccgagggagccaatgccagctacatcttgatccgggacacccacagcttgaggaccac

SEQ ID NO: 8075 - DNA, 201 bp, Homo sapiens
catcatgaagcgtggagacagcttcctcgatgggacccggtgtatgccaagtggcccccgggaggacgggaccctgagcctgtgtgtgtcgggcagctgcrggacatttggctgtgatggtaggatggactcccagcaggtatgggacaggtgccaggtgtgtggtggggacaacagcacgtgcagcccacggaagggctc

SEQ ID NO: 8076 - DNA, 119 bp, Homo sapiens
atgcaccagcgtcaccccygggcaagatgccctcccctctgtgtggccggaatccttgcctgtggctttctcctgggctgctggggaccctcccatttccagcagagttgtcttcaggc

SEQ ID NO: 8077 - DNA, 201 bp, Homo sapiens
cctgtgcatggactctgccctcagggtgcctgtccaggaagagctgtgtggcctggcaagcaagcctgggagccggcgggaggtctgccaggctgtcccgkgccctgctcggtggcagtacaagctggcggcctgcagcgtgagctgtgggagaggggtcgtgcggaggatcctgtattgtgcccgggcccatggggagga

SEQ ID NO: 8078 - DNA, 201 bp, Homo sapiens
cccggaaccccaggaggcctgcagcctggagccctgcccacctaggtggaaagtcatgtcccttggcccatgttcggccagctgtggccttggcactgctwgacgctcggtggcctgtgtgcagctcgaccaaggccaggacgtggaggtggacgaggcggcctgtgcggcgctggtgcggcccgaggccagtgtcccctg

SEQ ID NO: 8079 - DNA, 201 bp, Homo sapiens
gaccatcaaccctgaggacgacacggatcctggccatgctgacctggtcctctatatcactaggtttgacctggagttgcctgatggtaaccggcaggtgyggggcgtcacccagctgggcggtgcctgctccccaacctggagctgcctcattaccgaggacactggcttcgacctgggagtcaccattgcccatgagat

SEQ ID NO: 8080 - DNA, 201 bp, Homo sapiens
ctgctccccaacctggagctgcctcattaccgaggacactggcttcgacctgggagtcaccattgcccatgagattgggcacagcttcggcctggagcacsacggcgcgcccggcagcggctgcggccccagcggacacgtgatggcttcggaacggcgccgccccgcgccggcctcgcctggtccccctgcagccgccgg

SEQ ID NO: 8081 - DNA, 161 bp, Homo sapiens
caattcgaactttttccaatcttaggtatctactttagagtcttctccaatgtccaaaaggctagggggttggaggtggggactctggaaaagcagccccyatttcctcgggtaccaataaataaaacatgcaggctgaccggcgtttttttcttataagc

SEQ ID NO: 8082 - DNA, 201 bp, Homo sapiens
acacgtgatggcttcggaacggcgccgccccgcgccggcctcgcctggtccccctgcagccgccggcagctgctgagcctgctcagcgccaacgagcagtrccgcgtggccttcggccccaaggctgtcgcctgcaccttcgccagggagcacctggatatgtgccaggccctctcctgccacacagacccgctggaccaa

SEQ ID NO: 8083 - DNA, 201 bp, Homo sapiens
gttggtgctgacctccaggccgagatgtgcaacactcaggcctgcgagaagacccagctggagttcatgtcgcaacagtgcgccaggaccgacggccagcygctgcgctcctcccctggcggcgcctccttctaccactggggtgctgctgtaccacacagccaaggggatgctctgtgcagacacatgtgccgggccatt

SEQ ID NO: 8084 - DNA, 201 bp, Homo sapiens
cctggaggagatccgcatctggggacccctccaggaagatgctgacatccaggtttacaggcggtatggcgaggagtatggcaacctcacccgcccagacwtcaccttcacctacttccagcctaagccacggcaggcctgggtgtgggccgctgtgcgtgggccctgctcggtgagctgtggggcagggctgcgctgggt

SEQ ID NO: 8085 - DNA, 201 bp, Homo sapiens
tgtggggcagggctgcgctgggtaaactacagctgcctggaccaggccaggaaggagttggtggagactgtccagtgccaagggagccagcagccaccagygtggccagaggcctgcgtgctcgaaccctgccctccctactgggcggtgggagacttcggcccatgcagcgcctcctgtgggggcggcctgcgggagcgg

SEQ ID NO: 8086 - DNA, 201 bp, Homo sapiens
tctgcaggggagaaggctccctccccatggggcagcatcaggacgggggctcaagctgcacacgtgtggacccctgcggcagggtcgtgctccgtctcctrcgggcgaggtctgatggagctgcgtttcctgtgcatggactctgccctcagggtgcctgtccaggaagagctgtgtggcctggcaagcaagcctgggagc

SEQ ID NO: 8087 - DNA, 201 bp, Homo sapiens
aggggagaaggctccctccccatggggcagcatcaggacgggggctcaagctgcacacgtgtggacccctgcggcagggtcgtgctccgtctcctgcgggygaggtctgatggagctgcgtttcctgtgcatggactctgccctcagggtgcctgtccaggaagagctgtgtggcctggcaagcaagcctgggagccggcg

SEQ ID NO: 8088 - DNA, 201 bp, Homo sapiens
gcaagcctgggagccggcgggaggtctgccaggctgtcccgtgccctgctcggtggcagtacaagctggcggcctgcagcgtgagctgtgggagaggggtygtgcggaggatcctgtattgtgcccgggcccatggggaggacgatggtgaggagatcctgttggacacccagtgccaggggctgcctcgcccggaacccc

SEQ ID NO: 8089 - DNA, 201 bp, Homo sapiens
ggctggggccatctggatgccacctctgcaggggagaaggctccctccccatggggcagcatcaggacgggggctcaagctgcacacgtgtggacccctgyggcagggtcgtgctccgtctcctgcgggcgaggtctgatggagctgcgtttcctgtgcatggactctgccctcagggtgcctgtccaggaagagctgtgt

SEQ ID NO: 8090 - DNA, 201 bp, Homo sapiens
tcccttaaaaggccgccctccttcccctggcttccagaggcagaggcagaggcagaggcgggctgcaggcggcatcctacacctggagctgctggtggccrtgggccccgatgtcttccaggctcaccaggaggacacagagcgctatgtgctcaccaacctcaacatcggggcagaactgcttcgggacccgtccctggg

SEQ ID NO: 8091 - DNA, 201 bp, Homo sapiens
ggctgctgggctgggccctgtgtgggacagggtgcctgtggcaggcagcaccttgagccaacaggaaccattgacatgcgaggcccagggcaggcagactrtgcagtggccattgggcggcccctcggggaggtggtgaccctccgcgtccttgagagttctctcaactgcagtgcgggggacatgttgctgctttggggc

SEQ ID NO: 8092 - DNA, 201 bp, Homo sapiens
tgtcacatttctgacagttacccccaacctgaccagtgtctacattgccaaccacaggcctctcttcacacacttggcggtgaggatcggagggcgctatrtcgtggctgggaagatgagcatctcccctaacaccacctacccctccctcctggaggatggtcgtgtcgagtacagagtggccctcaccgaggaccggct

SEQ ID NO: 8093 - DNA, 201 bp, Homo sapiens
tggtggccgtgggccccgatgtcttccaggctcaccaggaggacacagagcgctatgtgctcaccaacctcaacatcggggcagaactgcttcgggacccrtccctgggggctcagtttcgggtgcacctggtgaagatggtcattctgacagagcctgagggtgctccaaatatcacagccaacctcacctcgtccctgc

SEQ ID NO: 8094 - DNA, 201 bp, Homo sapiens
acctcaacatcggggcagaactgcttcgggacccgtccctgggggctcagtttcgggtgcacctggtgaagatggtcattctgacagagcctgagggtgcyccaaatatcacagccaacctcacctcgtccctgctgagcgtctgtgggtggagccagaccatcaaccctgaggacgacacggatcctggccatgctgacc

SEQ ID NO: 8095 - DNA, 201 bp, Homo sapiens
tcaaccctgaggacgacacggatcctggccatgctgacctggtcctctatatcactaggtttgacctggagttgcctgatggtaaccggcaggtgcggggygtcacccagctgggcggtgcctgctccccaacctggagctgcctcattaccgaggacactggcttcgacctgggagtcaccattgcccatgagattgggc

SEQ ID NO: 8096 - DNA, 201 bp, Homo sapiens
agcaggtatgggacaggtgccaggtgtgtggtggggacaacagcacgtgcagcccacggaagggctctttcacagctggcagagcgagagaatatgtcacrtttctgacagttacccccaacctgaccagtgtctacattgccaaccacaggcctctcttcacacacttggcggtgaggatcggagggcgctatgtcgtgg

SEQ ID NO: 8097 - DNA, 201 bp, Homo sapiens
cattgccaaccacaggcctctcttcacacacttggcggtgaggatcggagggcgctatgtcgtggctgggaagatgagcatctcccctaacaccacctacscctccctcctggaggatggtcgtgtcgagtacagagtggccctcaccgaggaccggctgccccgcctggaggagatccgcatctggggacccctccagga

SEQ ID NO: 8098 - DNA, 201 bp, Homo sapiens
ggatggcatccagcgccggcgtgacacctgcctcggaccccaggcccaggcgcctgtgccagctgatttctgccagcacttgcccaagccggtgactgtgygtggctgctgggctgggccctgtgtgggacagggtgcctgtggcaggcagcaccttgagccaacaggaaccattgacatgcgaggcccagggcaggcaga

SEQ ID NO: 8099 - DNA, 201 bp, Homo sapiens; identical to SEQ ID NO: 8058

SEQ ID NO: 8100 - DNA, 201 bp, Homo sapiens; identical to SEQ ID NO: 8059

SEQ ID NO: 8101 - DNA, 201 bp, Homo sapiens; identical to SEQ ID NO: 8060

SEQ ID NO: 8102 - DNA, 201 bp, Homo sapiens; identical to SEQ ID NO: 8061

SEQ ID NO: 8103 - DNA, 201 bp, Homo sapiens; identical to SEQ ID NO: 8062

SEQ ID NO: 8104 - DNA, 201 bp, Homo sapiens; identical to SEQ ID NO: 8063

SEQ ID NO: 8105 - DNA, 201 bp, Homo sapiens; identical to SEQ ID NO: 8064

SEQ ID NO: 8106 - DNA, 201 bp, Homo sapiens; identical to SEQ ID NO: 8065

SEQ ID NO: 8107 - DNA, 192 bp, Homo sapiens; identical to SEQ ID NO: 8066

SEQ ID NO: 8108 - DNA, 201 bp, Homo sapiens; identical to SEQ ID NO: 8067

SEQ ID NO: 8109 - DNA, 201 bp, Homo sapiens
cgacggcgcgcccggcagcggctgcggccccagcggacacgtgatggcttcggaacggcgccgccccgcgccggcctcgcctggtccccctgcagccgccsgcagctgctgagcctgctcagcgcaggacgggcgcgctgcgtgtgggacccgccgcggcctcaacccgggtccgcggggcacccgccggatgcgcagcct

SEQ ID NO: 8110 - DNA, 201 bp, Homo sapiens; identical to SEQ ID NO: 8069

SEQ ID NO: 8111 - DNA, 201 bp, Homo sapiens; identical to SEQ ID NO: 8070

SEQ ID NO: 8112 - DNA, 201 bp, Homo sapiens; identical to SEQ ID NO: 8071

SEQ ID NO: 8113 - DNA, 201 bp, Homo sapiens; identical to SEQ ID NO: 8072

SEQ ID NO: 8114 - DNA, 201 bp, Homo sapiens; identical to SEQ ID NO: 8073

SEQ ID NO: 8115 - DNA, 201 bp, Homo sapiens; identical to SEQ ID NO: 8074

SEQ ID NO: 8116 - DNA, 201 bp, Homo sapiens; identical to SEQ ID NO: 8075

SEQ ID NO: 8117 - DNA, 119 bp, Homo sapiens; identical to SEQ ID NO: 8076

SEQ ID NO: 8118 - DNA, 201 bp, Homo sapiens; identical to SEQ ID NO: 8077

SEQ ID NO: 8119 - DNA, 201 bp, Homo sapiens; identical to SEQ ID NO: 8078

SEQ ID NO: 8120 - DNA, 201 bp, Homo sapiens; identical to SEQ ID NO: 8079

SEQ ID NO: 8121 - DNA, 201 bp, Homo sapiens; identical to SEQ ID NO: 8080

SEQ ID NO: 8122 - DNA, 161 bp, Homo sapiens; identical to SEQ ID NO: 8081

SEQ ID NO: 8123 - DNA, 201 bp, Homo sapiens
cgggcgcgctgcgtgtgggacccgccgcggcctcaacccgggtccgcggggcacccgccggatgcgcagcctggcctctactacagcgccaacgagcagtrccgcgtggccttcggccccaaggctgtcgcctgcaccttcgccagggagcacctggatatgtgccaggccctctcctgccacacagacccgctggaccaa

SEQ ID NO: 8124 - DNA, 201 bp, Homo sapiens; identical to SEQ ID NO: 8083

SEQ ID NO: 8125 - DNA, 201 bp, Homo sapiens; identical to SEQ ID NO: 8084

SEQ ID NO: 8126 - DNA, 201 bp, Homo sapiens; identical to SEQ ID NO: 8085

SEQ ID NO: 8127 - DNA, 201 bp, Homo sapiens; identical to SEQ ID NO: 8086

SEQ ID NO: 8128 - DNA, 201 bp, Homo sapiens; identical to SEQ ID NO: 8087

SEQ ID NO: 8129 - DNA, 201 bp, Homo sapiens; identical to SEQ ID NO: 8088

SEQ ID NO: 8130 - DNA, 201 bp, Homo sapiens; identical to SEQ ID NO: 8089

SEQ ID NO: 8131 - DNA, 201 bp, Homo sapiens; identical to SEQ ID NO: 8090

SEQ ID NO: 8132 - DNA, 201 bp, Homo sapiens
cccgggccccaggaaaactcagtgcagtccagtgcctgtggcaggcagcaccttgagccaacaggaaccattgacatgcgaggcccagggcaggcagactrtgcagtggccattgggcggcccctcggggaggtggtgaccctccgcgtccttgagagttctctcaactgcagtgcgggggacatgttgctgctttggggc

SEQ ID NO: 8133 - DNA, 201 bp, Homo sapiens; identical to SEQ ID NO: 8092

SEQ ID NO: 8134 - DNA, 201 bp, Homo sapiens; identical to SEQ ID NO: 8093

SEQ ID NO: 8135 - DNA, 201 bp, Homo sapiens; identical to SEQ ID NO: 8094

SEQ ID NO: 8136 - DNA, 201 bp, Homo sapiens; identical to SEQ ID NO: 8095

SEQ ID NO: 8137 - DNA, 201 bp, Homo sapiens; identical to SEQ ID NO: 8096

SEQ ID NO: 8138 - DNA, 201 bp, Homo sapiens; identical to SEQ ID NO: 8097

SEQ ID NO: 8139 - DNA, 201 bp, Homo sapiens
ggatggcatccagcgccggcgtgacacctgcctcggaccccaggcccaggcgcctgtgccagctgatttctgccagcacttgcccaagccggtgactgtgygtggctgctgggctgggccctgtgtgggacagggtacgcccagcctggtgccccacgaagaagccgctgctccaggacggaccacagccacccctgctgg

SEQ ID NO: 8140 - DNA, 201 bp, Homo sapiens; identical to SEQ ID NO: 8058

SEQ ID NO: 8141 - DNA, 201 bp, Homo sapiens; identical to SEQ ID NO: 8059

SEQ ID NO: 8142 - DNA, 201 bp, Homo sapiens; identical to SEQ ID NO: 8060

SEQ ID NO: 8143 - DNA, 201 bp, Homo sapiens; identical to SEQ ID NO: 8061

SEQ ID NO: 8144 - DNA, 201 bp, Homo sapiens; identical to SEQ ID NO: 8062

SEQ ID NO: 8145 - DNA, 201 bp, Homo sapiens; identical to SEQ ID NO: 8063

SEQ ID NO: 8146 - DNA, 201 bp, Homo sapiens; identical to SEQ ID NO: 8064

SEQ ID NO: 8147 - DNA, 201 bp, Homo sapiens; identical to SEQ ID NO: 8065

SEQ ID NO: 8148 - DNA, 192 bp, Homo sapiens; identical to SEQ ID NO: 8066

SEQ ID NO: 8149 - DNA, 201 bp, Homo sapiens; identical to SEQ ID NO: 8067

SEQ ID NO: 8150 - DNA, 201 bp, Homo sapiens; identical to SEQ ID NO: 8068

SEQ ID NO: 8151 - DNA, 201 bp, Homo sapiens; identical to SEQ ID NO: 8069

SEQ ID NO: 8152 - DNA, 201 bp, Homo sapiens; identical to SEQ ID NO: 8070

SEQ ID NO: 8153 - DNA, 201 bp, Homo sapiens; identical to SEQ ID NO: 8071

SEQ ID NO: 8154 - DNA, 201 bp, Homo sapiens; identical to SEQ ID NO: 8072

SEQ ID NO: 8155 - DNA, 201 bp, Homo sapiens; identical to SEQ ID NO: 8073

SEQ ID NO: 8156 - DNA, 201 bp, Homo sapiens; identical to SEQ ID NO: 8074

SEQ ID NO: 8157 - DNA, 201 bp, Homo sapiens; identical to SEQ ID NO: 8075

SEQ ID NO: 8158 - DNA, 201 bp, Homo sapiens; identical to SEQ ID NO: 8077

SEQ ID NO: 8159 - DNA, 201 bp, Homo sapiens; identical to SEQ ID NO: 8078

SEQ ID NO: 8160 - DNA, 201 bp, Homo sapiens; identical to SEQ ID NO: 8079

SEQ ID NO: 8161 - DNA, 201 bp, Homo sapiens; identical to SEQ ID NO: 8080

SEQ ID NO: 8162 - DNA, 161 bp, Homo sapiens; identical to SEQ ID NO: 8081

SEQ ID NO: 8163 - DNA, 201 bp, Homo sapiens; identical to SEQ ID NO: 8082

SEQ ID NO: 8164 - DNA, 201 bp, Homo sapiens; identical to SEQ ID NO: 8083

SEQ ID NO: 8165 - DNA, 201 bp, Homo sapiens; identical to SEQ ID NO: 8084

SEQ ID NO: 8166 - DNA, 201 bp, Homo sapiens; identical to SEQ ID NO: 8085

SEQ ID NO: 8167 - DNA, 201 bp, Homo sapiens; identical to SEQ ID NO: 8086

SEQ ID NO: 8168 - DNA, 201 bp, Homo sapiens; identical to SEQ ID NO: 8087

SEQ ID NO: 8169 - DNA, 201 bp, Homo sapiens; identical to SEQ ID NO: 8088

SEQ ID NO: 8170 - DNA, 201 bp, Homo sapiens; identical to SEQ ID NO: 8089

SEQ ID NO: 8171 - DNA, 201 bp, Homo sapiens; identical to SEQ ID NO: 8090

SEQ ID NO: 8172 - DNA, 201 bp, Homo sapiens; identical to SEQ ID NO: 8091

SEQ ID NO: 8173 - DNA, 201 bp, Homo sapiens; identical to SEQ ID NO: 8092

SEQ ID NO: 8174 - DNA, 201 bp, Homo sapiens; identical to SEQ ID NO: 8093

SEQ ID NO: 8175 - DNA, 201 bp, Homo sapiens; identical to SEQ ID NO: 8094

SEQ ID NO: 8176 - DNA, 201 bp, Homo sapiens; identical to SEQ ID NO: 8095

SEQ ID NO: 8177 - DNA, 201 bp, Homo sapiens; identical to SEQ ID NO: 8096

SEQ ID NO: 8178 - DNA, 201 bp, Homo sapiens; identical to SEQ ID NO: 8097

SEQ ID NO: 8179 - DNA, 201 bp, Homo sapiens; identical to SEQ ID NO: 8098

SEQ ID NO: 8180 - DNA, 201 bp, Homo sapiens; identical to SEQ ID NO: 8083

SEQ ID NO: 8181 - DNA, 201 bp, Homo sapiens; identical to SEQ ID NO: 8058

SEQ ID NO: 8182 - DNA, 201 bp, Homo sapiens; identical to SEQ ID NO: 8086

SEQ ID NO: 8183 - DNA, 201 bp, Homo sapiens; identical to SEQ ID NO: 8087

SEQ ID NO: 8184 - DNA, 201 bp, Homo sapiens; identical to SEQ ID NO: 8088

SEQ ID NO: 8185 - DNA, 201 bp, Homo sapiens; identical to SEQ ID NO: 8089

SEQ ID NO: 8186 - DNA, 201 bp, Homo sapiens
cccctccaggaagatgctgacatccaggtgggaggtgtcagagcccagctcatgcacatcagctggtggagcaggcctggccttggagaacgagacctgtrtgccaggggcagatggcctggaggctccagtgactgaggggcctggctccgtagatgagaagctgcctgcccctgagccctgtgtcgggatgtcatgtcc

SEQ ID NO: 8187 - DNA, 201 bp, Homo sapiens; identical to SEQ ID NO: 8090

SEQ ID NO: 8188 - DNA, 201 bp, Homo sapiens; identical to SEQ ID NO: 8065

SEQ ID NO: 8189 - DNA, 201 bp, Homo sapiens; identical to SEQ ID NO: 8067

SEQ ID NO: 8190 - DNA, 201 bp, Homo sapiens
ctgtcgcctgcaccttcgccagggagcacctggtgagtctgccggcggtggcctgggattggctgtgaggtccctccgcatcacccagctcacgtcccccmaaacgtgcatggatatgtgccaggccctctcctgccacacagacccgctggaccaaagcagctgcagccgcctcctcgttcctctcctggatgggacaga

SEQ ID NO: 8191 - DNA, 201 bp, Homo sapiens
cgacggcgcgcccggcagcggctgcggccccagcggacacgtgatggcttcggaacggcgccgccccgcgccggcctcgcctggtccccctgcagccgccsgcagctgctgagcctgctcagacccgtccctccgtcgccgctccctctgctggccacccacctctgcgccggcaggagccttagtcttggtcccagccaa

SEQ ID NO: 8192 - DNA, 201 bp, Homo sapiens; identical to SEQ ID NO: 8092

SEQ ID NO: 8193 - DNA, 201 bp, Homo sapiens
ttcacacacttggcggtgaggatcggagggcgctatgtcgtggctgggaagatgagcatctcccctaacaccacctacccctccctcctggaggatggtcrtgtcgagtacagagtggccctcaccgaggaccggctgccccgcctggaggagatccgcatctggggacccctccaggaagatgctgacatccaggtggga

SEQ ID NO: 8194 - DNA, 201 bp, Homo sapiens; identical to SEQ ID NO: 8070

SEQ ID NO: 8195 - DNA, 201 bp, Homo sapiens
agggcgctatgtcgtggctgggaagatgagcatctcccctaacaccacctacccctccctcctggaggatggtcgtgtcgagtacagagtggccctcaccraggaccggctgccccgcctggaggagatccgcatctggggacccctccaggaagatgctgacatccaggtgggaggtgtcagagcccagctcatgcacat

SEQ ID NO: 8196 - DNA, 201 bp, Homo sapiens; identical to SEQ ID NO: 8072

SEQ ID NO: 8197 - DNA, 201 bp, Homo sapiens; identical to SEQ ID NO: 8073

SEQ ID NO: 8198 - DNA, 201 bp, Homo sapiens; identical to SEQ ID NO: 8093

SEQ ID NO: 8199 - DNA, 201 bp, Homo sapiens
cagcctggcctctactacagcgccaacgagcagtgccgcgtggccttcggccccaaggctgtcgcctgcaccttcgccagggagcacctggtgagtctgcyggcggtggcctgggattggctgtgaggtccctccgcatcacccagctcacgtccccccaaacgtgcatggatatgtgccaggccctctcctgccacacag

SEQ ID NO: 8200 - DNA, 201 bp, Homo sapiens; identical to SEQ ID NO: 8094

SEQ ID NO: 8201 - DNA, 201 bp, Homo sapiens; identical to SEQ ID NO: 8075

SEQ ID NO: 8202 - DNA, 201 bp, Homo sapiens; identical to SEQ ID NO: 8095

SEQ ID NO: 8203 - DNA, 201 bp, Homo sapiens; identical to SEQ ID NO: 8077

SEQ ID NO: 8204 - DNA, 201 bp, Homo sapiens; identical to SEQ ID NO: 8096

SEQ ID NO: 8205 - DNA, 201 bp, Homo sapiens; identical to SEQ ID NO: 8097

SEQ ID NO: 8206 - DNA, 201 bp, Homo sapiens; identical to SEQ ID NO: 8079

SEQ ID NO: 8207 - DNA, 201 bp, Homo sapiens; identical to SEQ ID NO: 8080

SEQ ID NO: 8208 - DNA, 201 bp, Homo sapiens
cgggcgcgctgcgtgtgggacccgccgcggcctcaacccgggtccgcggggcacccgccggatgcgcagcctggcctctactacagcgccaacgagcagtrccgcgtggccttcggccccaaggctgtcgcctgcaccttcgccagggagcacctggtgagtctgccggcggtggcctgggattggctgtgaggtccctcc

SEQ ID NO: 8209 - DNA, 201 bp, Homo sapiens
caagaaatacggcactcgctgctccagctgctggctggtgcccaggaaaaatgtccagcccaagaggctatgtggcagatgtggagtgtccctggaccccrttcaggaaggttaaacccagcttcaccctgctgagctgctgcttctgcctccgtttcaccagtgggagaatgggcagaagcagctctcctaggaggattg

SEQ ID NO: 8210 - DNA, 201 bp, Homo sapiens
gagctgctgcttctgcctccgtttcaccagtgggagaatgggcagaagcagctctcctaggaggattggggaaagagccggcctgcctcctctctgccatytccagattcaaggatcccgggggaagacccaggcctcaggtggcagagcctgctaggggtcaccagccccttctccagtcagccttggccgaggccccct

SEQ ID NO: 8211 - DNA, 201 bp, Homo sapiens; identical to SEQ ID NO: 8210

SEQ ID NO: 8212 - DNA, 201 bp, Homo sapiens
tataccccagccgtggggcccggggtccctgccgcagccccctccccttctgatgccttaaaagctgggccccaggccctgctggccagagccacagatgscaagctctgggagcttgactatggaccaaacagctctggcctagggattgggccaccctacccaggatctccaccctggggacagtagaaggggaaagcc

SEQ ID NO: 8213 - DNA, 201 bp, Homo sapiens
ctgcctcattgctcctgtaattttggcctttcgagtgccttggaggtttccctgacctcccgtgaagatacagagactgtctcctttttttttaactttgwcaactgacttctgtttccttttctaagttttatttttcaaaccaccccggacagcccccagctctgattccttcaaggcccggcctgtccgggccaccat

SEQ ID NO: 8214 - DNA, 201 bp, Homo sapiens
gacgtgtccgttactcaccggcccccgctgagccctaagtctggggccgaagtcgaagccggcgatgccgcggagcgccgggcgccggaagaagagctgcygcctctagatccagaagagatccggaaacgcctggaacacaccgagcgccagttccgtaaccgccgcaagatactgatccggggcctcccgggggacgtg

SEQ ID NO: 8215 - DNA, 201 bp, Homo sapiens
aaggggaaagccttcatcttggcgaaccggccccaccaccccctcctacccgggcctccgtgcagagatgggctttctctgccagtcccctgctgtctgtmtgtgggagtcggacattgtgcccatctcccggagcctctgctgtcactcgcttgttgaagatgaattcttgaattctgcctgcccacccccggccagatc

SEQ ID NO: 8216 - DNA, 201 bp, Homo sapiens
cggctcgctggtcccagaaggcgccgggtttcccaagatggcggcggacgtgtccgttactcaccggcccccgctgagccctaagtctggggccgaagtcraagccggcgatgccgcggagcgccgggcgccggaagaagagctgccgcctctagatccagaagagatccggaaacgcctggaacacaccgagcgccagtt

SEQ ID NO: 8217 - DNA, 201 bp, Homo sapiens
aagacgacatgctagacatggcccccctcctccaggagaactcgcggctgggctgccagattgtgctgacaccggagctggaaggagcggaattcaccctkcccaagatcaccaggaacttctacgtggatggccatgtccccaagccccactgacatgaacacctggaccattccacattgccatggccccagggcccag

SEQ ID NO: 8218 - DNA, 201 bp, Homo sapiens
agccttcaatctcagcaacgtgactggcaacagtcggatcctctgctcagtgtactgcaatggctcccagataacaggctcctctaacatcaccgtgtacrggctcccggagcgtgtggagctggcacccctgcctccttggcagccggtgggccagaacttcaccctgcgctgccaagtggaggatgggtcgccccggac

SEQ ID NO: 8219 - DNA, 201 bp, Homo sapiens
gtcggtgagtcacgtgatgcatgtcatggccgcctccatggcccggggaggcgtgagtgccagggttctgctgcaggctgccaggggcacctggtggaacrgacctgggggcacttccgggtcgggggagggggtggcgctggggacaaccagaaagtttcaagcgacaggctcgcgcccggctggagaggaggacgcggg

SEQ ID NO: 8220 - DNA, 157 bp, Homo sapiens
ttcccctgcctgcccttcgggcacctcaggaaggcaccttcctctgtcagaatggcyaccatggtaccatccgtgttgtggcccagggcctgctggactctgctggtctgctgtctgctgaccccaggtgtccaggggcaggagttccttttgcggg

SEQ ID NO: 8221 - DNA, 201 bp, Homo sapiens
ccaatcgacgggcgcgccctcgttgccgctctatgccgctccgccccggctcgctggtcccagaaggcgccgggtttcccaagatggcggcggacgtgtcygttactcaccggcccccgctgagccctaagtctggggccgaagtcgaagccggcgatgccgcggagcgccgggcgccggaagaagagctgccgcctctag

SEQ ID NO: 8222 - DNA, 201 bp, Homo sapiens
aacatcaccgtgtacaggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccact

SEQ ID NO: 8223 - DNA, 201 bp, Homo sapiens
agaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagg

SEQ ID NO: 8224 - DNA, 201 bp, Homo sapiens
ggggcacctggtggaacagacctgggggcacttccgggtcgggggagggggtggcgctggggacaaccagaaagtttcaagcgacaggctcgcgcccggckggagaggaggacgcgggcggcccggagcggcccggggacgtggtgaacgtggtgttcgtagaccgctcaggccagcggatcccagtgagtggcagagtcg

SEQ ID NO: 8225 - DNA, 201 bp, Homo sapiens
tgtgctgggcccccggttctcttttccctctgggatctaagatgccgctggggatccaaggcagaggcctgggagcccccatttccgagggggagggctarcgtggaaggccccgccccggcagctgcggagggatttggtggggtccaggccgcccttgccacgcaggggtgcgcggatgacctgaaaaaagccagaaag

SEQ ID NO: 8226 - DNA, 201 bp, Homo sapiens
tccctcgcctccctggcgcggcgcatgctcagtcggtgagtcacgtgatgcatgtcatggccgcctccatggcccggggaggcgtgagtgccagggttctrctgcaggctgccaggggcacctggtggaacagacctgggggcacttccgggtcgggggagggggtggcgctggggacaaccagaaagtttcaagcgacag

SEQ ID NO: 8227 - DNA, 201 bp, Homo sapiens
caaaggagctggtggccagtggcatgggctgggcagccttcaatctcagcaacgtgactggcaacagtcggatcctctgctcagtgtactgcaatggctcycagataacaggctcctctaacatcaccgtgtacaggctcccggagcgtgtggagctggcacccctgcctccttggcagccggtgggccagaacttcaccc

SEQ ID NO: 8228 - DNA, 201 bp, Homo sapiens
tgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagcttcctaggacccattgtgaacctcagcgagccca

SEQ ID NO: 8229 - DNA, 201 bp, Homo sapiens; identical to SEQ ID NO: 8209

SEQ ID NO: 8230 - DNA, 201 bp, Homo sapiens
gcggtgttactgaccctgggcgtggtgactatcgtactggccttaatgtacgtcttcagggagcaccaacggagcggcagttaccatgttagggaggagascacctatctgcccctcacgtctatgcagccgacagaagcaatgggggaagaaccgtccagagctgagtgacgctgggatccgggatcaaagttggcgggg

SEQ ID NO: 8231 - DNA, 201 bp, Homo sapiens
agcagcagttcgaggagctggtgcggcccttcggcagcctggagcgctgcttcctggtctacagtgagcgcactggccaatccaagggctatggctttgcygagtacatgaagaaggactcggctgcccgtgccaagtcggacctgctgggcaagccgctgggaccacgcaccctctacgtgcactggacggatgccgggc

SEQ ID NO: 8232 - DNA, 201 bp, Homo sapiens; identical to SEQ ID NO: 8227

SEQ ID NO: 8233 - DNA, 201 bp, Homo sapiens
ggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtctcactgctgggggagcccccca

SEQ ID NO: 8234 - DNA, 201 bp, Homo sapiens
tggagcgctgcttcctggtctacagtgagcgcactggccaatccaagggctatggctttgctgagtacatgaagaaggactcggctgcccgtgccaagtcrgacctgctgggcaagccgctgggaccacgcaccctctacgtgcactggacggatgccgggcaactgacgcctgcccttctccactcccgctgcctctgtg

SEQ ID NO: 8235 - DNA, 201 bp, Homo sapiens; identical to SEQ ID NO: 8214

SEQ ID NO: 8236 - DNA, 184 bp, Homo sapiens
ctgcctcattgctcctgtaattttggcctttcgagtgccttggaggtttccctgacctcccgtgaagatacagagactgtctcctttttttttaactttgwcgctctgattccttcaaggcccggcctgtccgggccaccattccacaccttgcggtttgaaacagctgtttttcccacatttg

SEQ ID NO: 8237 - DNA, 201 bp, Homo sapiens; identical to SEQ ID NO: 8228

SEQ ID NO: 8238 - DNA, 201 bp, Homo sapiens; identical to SEQ ID NO: 8216

SEQ ID NO: 8239 - DNA, 201 bp, Homo sapiens
gggcgctgtcagctgtccacagccccaccttctgccagctggcgtgcggccaggatgggcagctgaagggcttcgcggtgctggagtatgagacggctgakatggcggaggaggcacagcagcaggcggacggcctgtccctggggggcagccacctgcgagtctccttctgcgcccctgggccccccggccgcagtatgc

SEQ ID NO: 8240 - DNA, 201 bp, Homo sapiens
ttgtggacaaatacaaagggacagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 8241 - DNA, 201 bp, Homo sapiens; identical to SEQ ID NO: 8218

SEQ ID NO: 8242 - DNA, 201 bp, Homo sapiens; identical to SEQ ID NO: 8221

SEQ ID NO: 8243 - DNA, 157 bp, Homo sapiens; identical to SEQ ID NO: 8220

SEQ ID NO: 8244 - DNA, 201 bp, Homo sapiens; identical to SEQ ID NO: 8222

SEQ ID NO: 8245 - DNA, 201 bp, Homo sapiens; identical to SEQ ID NO: 8230

SEQ ID NO: 8246 - DNA, 201 bp, Homo sapiens; identical to SEQ ID NO: 8231

SEQ ID NO: 8247 - DNA, 201 bp, Homo sapiens; identical to SEQ ID NO: 8227

SEQ ID NO: 8248 - DNA, 201 bp, Homo sapiens; identical to SEQ ID NO: 8234

SEQ ID NO: 8249 - DNA, 201 bp, Homo sapiens; identical to SEQ ID NO: 8214

SEQ ID NO: 8250 - DNA, 201 bp, Homo sapiens; identical to SEQ ID NO: 8216

SEQ ID NO: 8251 - DNA, 201 bp, Homo sapiens; identical to SEQ ID NO: 8228

SEQ ID NO: 8252 - DNA, 201 bp, Homo sapiens; identical to SEQ ID NO: 8239

SEQ ID NO: 8253 - DNA, 201 bp, Homo sapiens
ctcccgggggacgtgaccaaccagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 8254 - DNA, 201 bp, Homo sapiens; identical to SEQ ID NO: 8218

SEQ ID NO: 8255 - DNA, 157 bp, Homo sapiens; identical to SEQ ID NO: 8220

SEQ ID NO: 8256 - DNA, 201 bp, Homo sapiens; identical to SEQ ID NO: 8221

SEQ ID NO: 8257 - DNA, 201 bp, Homo sapiens; identical to SEQ ID NO: 8222

SEQ ID NO: 8258 - DNA, 201 bp, Homo sapiens; identical to SEQ ID NO: 8230

SEQ ID NO: 8259 - DNA, 201 bp, Homo sapiens; identical to SEQ ID NO: 8215

SEQ ID NO: 8260 - DNA, 201 bp, Homo sapiens; identical to SEQ ID NO: 8217

SEQ ID NO: 8261 - DNA, 201 bp, Homo sapiens; identical to SEQ ID NO: 8224

SEQ ID NO: 8262 - DNA, 201 bp, Homo sapiens; identical to SEQ ID NO: 8226

SEQ ID NO: 8263 - DNA, 201 bp, Homo sapiens; identical to SEQ ID NO: 8219

SEQ ID NO: 8264 - DNA, 201 bp, Homo sapiens; identical to SEQ ID NO: 8225

SEQ ID NO: 8265 - DNA, 201 bp, Homo sapiens; identical to SEQ ID NO: 8212

SEQ ID NO: 8266 - DNA, 201 bp, Homo sapiens; identical to SEQ ID NO: 8213

SEQ ID NO: 8267 - DNA, 201 bp, Homo sapiens; identical to SEQ ID NO: 8212

SEQ ID NO: 8268 - DNA, 201 bp, Homo sapiens; identical to SEQ ID NO: 8213

SEQ ID NO: 8269 - DNA, 201 bp, Homo sapiens; identical to SEQ ID NO: 8214

SEQ ID NO: 8270 - DNA, 201 bp, Homo sapiens; identical to SEQ ID NO: 8215

SEQ ID NO: 8271 - DNA, 201 bp, Homo sapiens; identical to SEQ ID NO: 8216

SEQ ID NO: 8272 - DNA, 201 bp, Homo sapiens; identical to SEQ ID NO: 8217

SEQ ID NO: 8273 - DNA, 201 bp, Homo sapiens; identical to SEQ ID NO: 8218

SEQ ID NO: 8274 - DNA, 201 bp, Homo sapiens; identical to SEQ ID NO: 8219

SEQ ID NO: 8275 - DNA, 157 bp, Homo sapiens; identical to SEQ ID NO: 8220

SEQ ID NO: 8276 - DNA, 201 bp, Homo sapiens; identical to SEQ ID NO: 8221

SEQ ID NO: 8277 - DNA, 201 bp, Homo sapiens; identical to SEQ ID NO: 8222

SEQ ID NO: 8278 - DNA, 201 bp, Homo sapiens; identical to SEQ ID NO: 8224

SEQ ID NO: 8279 - DNA, 201 bp, Homo sapiens; identical to SEQ ID NO: 8225

SEQ ID NO: 8280 - DNA, 201 bp, Homo sapiens; identical to SEQ ID NO: 8226

SEQ ID NO: 8281 - DNA, 201 bp, Homo sapiens; identical to SEQ ID NO: 8227

SEQ ID NO: 8282 - DNA, 201 bp, Homo sapiens; identical to SEQ ID NO: 8228

SEQ ID NO: 8283 - DNA, 201 bp, Homo sapiens; identical to SEQ ID NO: 8230

SEQ ID NO: 8284 - DNA, 201 bp, Homo sapiens
tttccatgccagagagtggatttctcctgcattctgccagtggtttgtaagagaggctgttcgtacctatggacgtgagatccaagtgacagagcttctcracaagttagacttttatgtcctgcctgtgctcaatattgatggctacatctacacctggaccaagagccgattttggagaaagactcgctccacccatac

SEQ ID NO: 8285 - DNA, 201 bp, Homo sapiens
gctctgacgactgggcttatgaccaaggaatcagatattccttcacctttgaacttcgagatacaggcagatatggctttctccttccagaatcccagatscgggctacctgcgaggagaccttcctggcaatcaagtatgttgccagctacgtcctggaacacctgtactagttgagaaagctgatggccttgtttcaaa

SEQ ID NO: 8286 - DNA, 116 bp, Homo sapiens
ttctctctctctctcrctcttggttctggtgactgtggccctggcatctgctcatcatggtggtgagcactttgaaggcgagaaggtgttccgtgttaacgttgaagatgaaaatc

SEQ ID NO: 8287 - DNA, 201 bp, Homo sapiens; identical to SEQ ID NO: 8284

SEQ ID NO: 8288 - DNA, 201 bp, Homo sapiens
agctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtgttgagagagataccctctcagactttacacagctaccaaggcaac

SEQ ID NO: 8289 - DNA, 201 bp, Homo sapiens
gctaccaaggcaacaatgccaggaaaactattaatcaagatatgatagttcctgtttgcaatcaggagaagaaagcaaagaacactcaggattataaaagyagatgagacctacccactagacctggtcagacacaatgttggcactcttggttctggtgactgtggccctggcatctgctcatcatggtggtgagcactt

SEQ ID NO: 8290 - DNA, 201 bp, Homo sapiens; identical to SEQ ID NO: 8285

SEQ ID NO: 8291 - DNA, 201 bp, Homo sapiens
atagttcctgtttgcaatcaggagaagaaagcaaagaacactcaggattataaaagcagatgagacctacccactagacctggtcagacacaatgttggcrctcttggttctggtgactgtggccctggcatctgctcatcatggtggtgagcactttgaaggcgagaaggtgttccgtgttaacgttgaagatgaaaatc

SEQ ID NO: 8292 - DNA, 201 bp, Homo sapiens
tccccctcggtgtatttctactaataaatgcacagctccagaagttgaaaatgcaattagagtaccaggaaacaggagtttctttaccctcactgagatcrtcagatttagatgtcagcccgggtttgtcatggtagggtcccacactgtgcagtgccagaccaatggcagatgggggcccaagctgccacactgctccag

SEQ ID NO: 8293 - DNA, 201 bp, Homo sapiens
ttgcaccagcaaagatgatcaagttggtgtttggagcagccctccccctcggtgtatttctactaataaatgcacagctccagaagttgaaaatgcaattrgagtaccaggaaacaggagtttctttaccctcactgagatcatcagatttagatgtcagcccgggtttgtcatggtagggtcccacactgtgcagtgcca

SEQ ID NO: 8294 - DNA, 201 bp, Homo sapiens
ctcgctgtgaactttctgttcgtgctggtcactgtaaaaccccagagcagtttccatttgccagtcctacgatcccaattaatgactttgagtttccagtygggacatctttgaattatgaatgccgtcctgggtattttgggaaaatgttctctatctcctgcctagaaaacttggtctggtcaagtgttgaagacaact

SEQ ID NO: 8295 - DNA, 201 bp, Homo sapiens
cctgccaacacgcccggctaatttttttgtatttttagtagagacggggtttcaccatgttagccaggatggtctggatctcctgacctcgtgatccaccygcctcggcctcccaaagtgctgcgattacaggcatgagccaccgcgcctggccgctttcgatattttctaaactttaattcaaaagcactttgtgctgtg

SEQ ID NO: 8296 - DNA, 201 bp, Homo sapiens
ggacatctttgaattatgaatgccgtcctgggtattttgggaaaatgttctctatctcctgcctagaaaacttggtctggtcaagtgttgaagacaactgyagacgaaaatcatgtggacctccaccagaacccttcaatggaatggtgcatataaacacagatacacagtttggatcaacagttaattattcttgtaatg

SEQ ID NO: 8297 - DNA, 201 bp, Homo sapiens
tctcccaggctggagtgcagtggcgtaatctcggctcactgcaagctccgcctcccgggttgacaccattttcctgcctcagcctcctgagtagttgggaytaccagtagatgggactacaggcacctgccaacacgcccggctaatttttttgtatttttagtagagacggggtttcaccatgttagccaggatggtctg

SEQ ID NO: 8298 - DNA, 201 bp, Homo sapiens
tcatgggaatggggtttggagcagccctgcccctcgctgtgaactttctgttcgtgctggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 8299 - DNA, 201 bp, Homo sapiens
tgctggcggttgtggtgctgcttgcgctgccggtggcctggggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 8300 - DNA, 201 bp, Homo sapiens
atagcagtgttccagtgtgtgaacaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 8301 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaagaagtaaattgtagcttcccactgtttatgaatggaatctcgaa

SEQ ID NO: 8302 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctgcctgcccacatccacccaagatccaaaacgggcattacatt

SEQ ID NO: 8303 - DNA, 201 bp, Homo sapiens
gggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcag

SEQ ID NO: 8304 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtcaatgcaatgccccagaatggcttccatttgccaggcctaccaacctaactgatgagtttgagtttcccattgggacat

SEQ ID NO: 8305 - DNA, 201 bp, Homo sapiens
aatgggagccggagctaccaagctgctccagggtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 8306 - DNA, 201 bp, Homo sapiens
cactgcaagctccgcctcccgggttgacaccattttcctgcctcagcctcctgagtagttgggactaccagtagatgggactacaggcacctgccaacackcccggctaatttttttgtatttttagtagagacggggtttcaccatgttagccaggatggtctggatctcctgacctcgtgatccacccgcctcggcctc

SEQ ID NO: 8307 - DNA, 201 bp, Homo sapiens
catgggaatggggtttggagcagccctgcccctcgctgtgaactttctgttcgtgctggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 8308 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtcaatgcaatgccccagaatggcttccatttgccaggcctaccaacctaactgatgagtttgagtttc

SEQ ID NO: 8309 - DNA, 201 bp, Homo sapiens
cagtgttccagtgtgtgaacaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 8310 - DNA, 201 bp, Homo sapiens
gtccaagtcctccagttattcctaatgggagacacacaggaaaacctctggaagtctttccctttgggaaaacagtaaattacacatgcgacccccacccrgacagagggacgagcttcgacctcattggagagagcaccatccgctgcacaagtgaccctcaagggaatggggtttggagcagccctgcccctcgctgtg

SEQ ID NO: 8311 - DNA, 201 bp, Homo sapiens
tccatccgctgcacaagtgaccctcaagggaatggggtttggagcagccctgcccctcgctgtgaactttctgttcctgctgcctgcccacatccacccargatccaaaacgggcattacattggaggacacgtatctctatatcttcctgggatgacaatcagctacatttgtgaccccggctacctgttagtgggaaag

SEQ ID NO: 8312 - DNA, 201 bp, Homo sapiens
gctgtttgagcttgtgggagaacggtcaatatattgcaccagcaaagatgatcaagttggtgtttggagcagccctccccctcggtgtatttctactaatraatgcacagctccagaagttgaaaatgcaattagagtaccaggaaacaggagtttctttaccctcactgagatcatcagatttagatgtcagcccgggtt

SEQ ID NO: 8313 - DNA, 201 bp, Homo sapiens
ctatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacag

SEQ ID NO: 8314 - DNA, 201 bp, Homo sapiens
tggagacttctacagcaacaatagaacatcttttcacaatggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaataaatgcacagctcc

SEQ ID NO: 8315 - DNA, 201 bp, Homo sapiens
tgggataagaaggcacctatttgtgagatcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 8316 - DNA, 201 bp, Homo sapiens
tgtttggagcagccctccccctcggtgtatttctactaataaatgcacagctccagaagttgaaaatgcaattagagtaccaggaaacaggagtttctttwccctcactgagatcatcagatttagatgtcagcccgggtttgtcatggtagggtcccacactgtgcagtgccagaccaatggcagatgggggcccaagct

SEQ ID NO: 8317 - DNA, 201 bp, Homo sapiens
ccccgccgtgtgaagtgccaggccctgaacaaatgggagccagagttaccaagctgctccagggtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 8318 - DNA, 201 bp, Homo sapiens
tgaatgccgccctggttattccggaagaccgttttctatcatctgcctaaaaaactcagtctggactggtgctaaggacaggtgcagacgtaaatcatgtygtaatcctccagatcctgtgaatggcatggtgcatgtgatcaaaggcatccagttcggatcccaaattaaatattcttgtactaaaggataccgactcat

SEQ ID NO: 8319 - DNA, 201 bp, Homo sapiens
tttgaagtgtgaagatgggtatactctggaaggcagtccctggagccagtgccaggcggatgacagatgggaccctcctctggccaaatgtacctctcgtrcacatgatgctctcatagttggcactttatctggtacgatcttctttattttactcatcattttcctctcttggataattctaaagcacagaaaaggcaa

SEQ ID NO: 8320 - DNA, 201 bp, Homo sapiens
actccagacagacggctttggaatccaccagctacatccagctccctgaggcagagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 8321 - DNA, 201 bp, Homo sapiens
ctggcctctcccagaggggctgctctgaagcatgtggatttgatcaggataatcaagtccgagaacagaacacttggttgtcctggcatttcccaagcagkgggaggagttctctgcaggaataaataagcctcagcattcatgaaaatccactactccagacagacggctttggaatccaccagctacatccagctccct

SEQ ID NO: 8322 - DNA, 152 bp, Homo sapiens
agtggccatggcatgtgtggccctgtctgcttatccttggaaggtgacagcgattccctgtgtagctctcacatgcacaggggcccatggactcttcagtytggagggtcctgggcctcctgacagcaataaataatttcgttggacacgtt

SEQ ID NO: 8323 - DNA, 201 bp, Homo sapiens
ggccggaggaaactcagcagacatgacgactaaatgcaatgtagaatcctcggacagaaaaggacattagtaggacagctggtgaaacccaaaggaagaayctgtgtcaggacccccagagcggtgtctccactaagcagaagtctctgtttctctcctggcctctcccagaggggctgctctgaagcatgtggatttgat

SEQ ID NO: 8324 - DNA, 201 bp, Homo sapiens
gctgccacagcagtcaaaatcaccctcctttctgcattagtggagacaaggaccattgtgcgtttcaacaggcccttcctgatgatcattgtccctacagrcacccagaacatcttcttcatgagcaaagtcaccaatcccaagcaagcctagagcttgccatcaagcagtggggctctcagtaaggaacttggaatgcaa

SEQ ID NO: 8325 - DNA, 201 bp, Homo sapiens
tgagcaagaaaaagtgggtaatggtgcccatgatgagtttgcatcacctgactataccttacttccgggacgaggagctgtcctgcaccgtggtggagctraagtacacaggcaatgccagcgcactcttcatcctccctgatcaagacaagatggaggaagtggaagccatgctgctcccagagaccctgaagcggtgga

SEQ ID NO: 8326 - DNA, 201 bp, Homo sapiens
gtctaatcacaagaaaatgacagccaatcccaagttcagggacatttggcaaaatagcccaccactcctacttaaaagtgtcgaggtcttgaaaggcaagraaaccctgggaaatcgtctttggccggaggaaactcagcagacatgacgactaaatgcaatgtagaatcctcggacagaaaaggacattagtaggacagc

SEQ ID NO: 8327 - DNA, 106 bp, Homo sapiens
acagcgattccctgtgtagctctcacatgcacaggggcccatggactcttcagtctggagggtcctgggcctcctgacagcaataaataatttcgttggamacgtt

SEQ ID NO: 8328 - DNA, 201 bp, Homo sapiens
acgtggacttcgctttcagcctgtacaagcagttagtcctgaaggcccctgataagaatgtcatcttctccccactgagcatctccaccgccttggccttyctgtctctgggggcccataataccaccctgacagagattctcaaaggcctcaagttcaacctcacggagacttctgaggcagaaattcaccagagcttcc

SEQ ID NO: 8329 - DNA, 201 bp, Homo sapiens
acagcccacttgacgaggagaatctgacccaggagaaccaagaccgagggacacacgtggacctcggattagcctccgccaacgtggacttcgctttcagyctgtacaagcagttagtcctgaaggcccctgataagaatgtcatcttctccccactgagcatctccaccgccttggccttcctgtctctgggggcccata

SEQ ID NO: 8330 - DNA, 201 bp, Homo sapiens
aaataagcctcagcattcatgaaaatccactactccagacagacggctttggaatccaccagctacatccagctccctgaggcagagttgagaatggagaraatgttacctctcctggctctggggctcttggcggctgggttctgccctgctgtcctctgccaccctaacagcccacttgacgaggagaatctgacccag

SEQ ID NO: 8331 - DNA, 201 bp, Homo sapiens
atcccaagttcagggacatttggcaaaatagcccaccactcctacttaaaagtgtcgaggtcttgaaaggcaaggaaaccctgggaaatcgtctttggccrgaggaaactcagcagacatgacgactaaatgcaatgtagaatcctcggacagaaaaggacattagtaggacagctggtgaaacccaaaggaagaacctgt

SEQ ID NO: 8332 - DNA, 201 bp, Homo sapiens
gatgccctttgacccccaagatactcatcagtcaaggttctacttgagcaagaaaaagtgggtaatggtgcccatgatgagtttgcatcacctgactatascttacttccgggacgaggagctgtcctgcaccgtggtggagctgaagtacacaggcaatgccagcgcactcttcatcctccctgatcaagacaagatgga

SEQ ID NO: 8333 - DNA, 201 bp, Homo sapiens
gtggacctcggattagcctccgccaacgtggacttcgctttcagcctgtacaagcagttagtcctgaaggcccctgataagaatgtcatcttctccccacygagcatctccaccgccttggccttcctgtctctgggggcccataataccaccctgacagagattctcaaaggcctcaagttcaacctcacggagacttct

SEQ ID NO: 8334 - DNA, 201 bp, Homo sapiens
cagggacatttggcaaaatagcccaccactcctacttaaaagtgtcgaggtcttgaaaggcaaggaaaccctgggaaatcgtctttggccggaggaaactmagcagacatgacgactaaatgcaatgtagaatcctcggacagaaaaggacattagtaggacagctggtgaaacccaaaggaagaacctgtgtcaggaccc

SEQ ID NO: 8335 - DNA, 201 bp, Homo sapiens
caccctcctttctgcattagtggagacaaggaccattgtgcgtttcaacaggcccttcctgatgatcattgtccctacagacacccagaacatcttcttcrtgagcaaagtcaccaatcccaagcaagcctagagcttgccatcaagcagtggggctctcagtaaggaacttggaatgcaagctggatgcctgggtctctg

SEQ ID NO: 8336 - DNA, 201 bp, Homo sapiens
aggcaaggaaaccctgggaaatcgtctttggccggaggaaactcagcagacatgacgactaaatgcaatgtagaatcctcggacagaaaaggacattagtrggacagctggtgaaacccaaaggaagaacctgtgtcaggacccccagagcggtgtctccactaagcagaagtctctgtttctctcctggcctctcccaga

SEQ ID NO: 8337 - DNA, 201 bp, Homo sapiens
tataatgtgacaagataacataatgaaaaagaatgaagaataaaatagaaaagtaaaatggattgcatgtcacttgatgacaagtactgtggaatgaggcygtcatctaaatggagcacagaaagtggaacatggcgacatctcagccaaaagacccggcagacaccatcttggccaagggatcgaggttggcatcgccag

SEQ ID NO: 8338 - DNA, 201 bp, Homo sapiens
aagataacataatgaaaaagaatgaagaataaaatagaaaagtaaaatggattgcatgtcacttgatgacaagtactgtggaatgaggccgtcatctaaayggagcacagaaagtggaacatggcgacatctcagccaaaagacccggcagacaccatcttggccaagggatcgaggttggcatcgccagctgtgagcagt

SEQ ID NO: 8339 - DNA, 201 bp, Homo sapiens
catgaaaatccactactccagacagacggctttggaatccaccagctacatccagctccctgaggcagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 8340 - DNA, 201 bp, Homo sapiens
tggtgcccatgatgagtttgcatcacctgactataccttacttccgggacgaggagctgtcctgcaccgtggtggagctgaagtacacaggcaatgccagygcactcttcatcctccctgatcaagacaagatggaggaagtggaagccatgctgctcccagagaccctgaagcggtggagagactctctggagttcagag

SEQ ID NO: 8341 - DNA, 159 bp, Homo sapiens
tgcaccgagtggccatggcatgtgtggccctgtctgcttatccttggaaggtgacagcgattccctgtgtagctctcacatgcacaggggcccatggactyttcagtctggagggtcctgggcctcctgacagcaataaataatttcgttggacacgtt

SEQ ID NO: 8342 - DNA, 168 bp, Homo sapiens
tggtgcacaaagctgtggtggaggtggacgagtcgggaaccagagcagcggcagccacggggacaatmttcactttcagatattcactgaatggccactgtgtgcctggcactgttccaagtgctgaagaaaaatgaagaaaacaaaaatccctgcccttatagagga

SEQ ID NO: 8343 - DNA, 201 bp, Homo sapiens
ctgactttcaggactcagctgcagctaagaagctcatcaacgactacgtgaagaatggaactagggggaaaatcacagatctgatcaaggaccttgactcrcagacaatgatggtcctggtgaattacatcttctttaaagccaaatgggagatgccctttgacccccaagatactcatcagtcaaggttctacttgagca

SEQ ID NO: 8344 - DNA, 201 bp, Homo sapiens
caaagttttccatctcgagggactataacctgaacgacatacttctccagctgggcattgaggaagccttcaccagcaaggctgacctgtcagggatcacrggggccaggaacctagcagtctcccaggtggtccataaggctgtgcttgatgtatttgaggagggcacagaagcatctgctgccacagcagtcaaaatca

SEQ ID NO: 8345 - DNA, 201 bp, Homo sapiens
ctgtttttccaggagagttttaggcagcagcctggagtgtgtggagtgtgagggagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 8346 - DNA, 152 bp, Homo sapiens; identical to SEQ ID NO: 8322

SEQ ID NO: 8347 - DNA, 201 bp, Homo sapiens; identical to SEQ ID NO: 8324

SEQ ID NO: 8348 - DNA, 201 bp, Homo sapiens; identical to SEQ ID NO: 8325

SEQ ID NO: 8349 - DNA, 106 bp, Homo sapiens; identical to SEQ ID NO: 8327

SEQ ID NO: 8350 - DNA, 160 bp, Homo sapiens
tttggaatccaccagctacatccagctccctgaggcaggtaatccatgatgttttacatyctgggagcggaggaatctgtttttccaggagagttttaggcagcagcctggagtgtgtggagtgtgagggagttgagaatggagagaatgttacctctcc

SEQ ID NO: 8351 - DNA, 201 bp, Homo sapiens; identical to SEQ ID NO: 8328

SEQ ID NO: 8352 - DNA, 201 bp, Homo sapiens; identical to SEQ ID NO: 8329

SEQ ID NO: 8353 - DNA, 201 bp, Homo sapiens
atgatgttttacatcctgggagcggaggaatctgtttttccaggagagttttaggcagcagcctggagtgtgtggagtgtgagggagttgagaatggagaraatgttacctctcctggctctggggctcttggcggctgggttctgccctgctgtcctctgccaccctaacagcccacttgacgaggagaatctgacccag

SEQ ID NO: 8354 - DNA, 201 bp, Homo sapiens; identical to SEQ ID NO: 8332

SEQ ID NO: 8355 - DNA, 201 bp, Homo sapiens; identical to SEQ ID NO: 8333

SEQ ID NO: 8356 - DNA, 201 bp, Homo sapiens; identical to SEQ ID NO: 8335

SEQ ID NO: 8357 - DNA, 201 bp, Homo sapiens
gggagcggaggaatctgtttttccaggagagttttaggcagcagcctggagtgtgtggagtgtgagggagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 8358 - DNA, 201 bp, Homo sapiens; identical to SEQ ID NO: 8340

SEQ ID NO: 8359 - DNA, 159 bp, Homo sapiens; identical to SEQ ID NO: 8341

SEQ ID NO: 8360 - DNA, 201 bp, Homo sapiens; identical to SEQ ID NO: 8343

SEQ ID NO: 8361 - DNA, 201 bp, Homo sapiens; identical to SEQ ID NO: 8344

SEQ ID NO: 8362 - DNA, 201 bp, Homo sapiens
tccaccagctacatccagctccctgaggcaggactgagtgggcggaggctgaagagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 8363 - DNA, 152 bp, Homo sapiens; identical to SEQ ID NO: 8322

SEQ ID NO: 8364 - DNA, 201 bp, Homo sapiens; identical to SEQ ID NO: 8324

SEQ ID NO: 8365 - DNA, 201 bp, Homo sapiens; identical to SEQ ID NO: 8325

SEQ ID NO: 8366 - DNA, 106 bp, Homo sapiens; identical to SEQ ID NO: 8327

SEQ ID NO: 8367 - DNA, 201 bp, Homo sapiens; identical to SEQ ID NO: 8328

SEQ ID NO: 8368 - DNA, 201 bp, Homo sapiens; identical to SEQ ID NO: 8329

SEQ ID NO: 8369 - DNA, 197 bp, Homo sapiens
cactactccagacagacggctttggaatccaccagctacatccagctccctgaggcaggactgagtgggcggaggctgaagagttgagaatggagaraatgttacctctcctggctctggggctcttggcggctgggttctgccctgctgtcctctgccaccctaacagcccacttgacgaggagaatctgacccag

SEQ ID NO: 8370 - DNA, 201 bp, Homo sapiens; identical to SEQ ID NO: 8332

SEQ ID NO: 8371 - DNA, 201 bp, Homo sapiens; identical to SEQ ID NO: 8333

SEQ ID NO: 8372 - DNA, 201 bp, Homo sapiens; identical to SEQ ID NO: 8335

SEQ ID NO: 8373 - DNA, 201 bp, Homo sapiens
agacggctttggaatccaccagctacatccagctccctgaggcaggactgagtgggcggaggctgaagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 8374 - DNA, 201 bp, Homo sapiens; identical to SEQ ID NO: 8340

SEQ ID NO: 8375 - DNA, 159 bp, Homo sapiens; identical to SEQ ID NO: 8341

SEQ ID NO: 8376 - DNA, 201 bp, Homo sapiens; identical to SEQ ID NO: 8343

SEQ ID NO: 8377 - DNA, 201 bp, Homo sapiens; identical to SEQ ID NO: 8344

SEQ ID NO: 8378 - DNA, 201 bp, Homo sapiens; identical to SEQ ID NO: 8332

SEQ ID NO: 8379 - DNA, 152 bp, Homo sapiens; identical to SEQ ID NO: 8322

SEQ ID NO: 8380 - DNA, 201 bp, Homo sapiens; identical to SEQ ID NO: 8335

SEQ ID NO: 8381 - DNA, 201 bp, Homo sapiens; identical to SEQ ID NO: 8324

SEQ ID NO: 8382 - DNA, 201 bp, Homo sapiens; identical to SEQ ID NO: 8325

SEQ ID NO: 8383 - DNA, 106 bp, Homo sapiens; identical to SEQ ID NO: 8327

SEQ ID NO: 8384 - DNA, 201 bp, Homo sapiens
tattttaggctgtgtggtccacatgagggcagattcttctttttgacttcctcctctgcatcttcttcatcttctctttcctcttcattttttttacaacstttgaaaaatataagcaccattcttagctttaggtacacacaaaaataagctatggctgtattggcttacaggctatagtttcctgacccctgttctagg

SEQ ID NO: 8385 - DNA, 201 bp, Homo sapiens; identical to SEQ ID NO: 8340

SEQ ID NO: 8386 - DNA, 159 bp, Homo sapiens; identical to SEQ ID NO: 8341

SEQ ID NO: 8387 - DNA, 201 bp, Homo sapiens
aatgcgtgcgaatcatgggcctatgtcatgattcccaaagaatgagtttcatggaattttcaacattttaaatattttactccattcttcccttgcttgcmtagtttctgatgagaagtctgctgtcattttcatccttattcctttttagataaggtggagttttcctccctctgcctctacctctacctctttcaagat

SEQ ID NO: 8388 - DNA, 201 bp, Homo sapiens
ggctctccctcacccccaataacttttactcttgccaagctacttctctaaaccaaagcagggtccctcctatgagggactctgggcacttccactgctgsggaagcagggtcgagcagggcgacccttgcactcacaccttctccaactgcttgctccaccttcagccaaatgggagatgccctttgacccccaagatac

SEQ ID NO: 8389 - DNA, 201 bp, Homo sapiens; identical to SEQ ID NO: 8344

SEQ ID NO: 8390 - DNA, 201 bp, Homo sapiens
attcatggttgcaatcacacaatgtcagtccctggtcactgggagtcatcatgtgccctgacttggggcctggccctctgcctctgtcttgcaggacaatrccattctctgtctcatggggcgtcctcctgctggcaggcctgtgctgcctggtccccagctccctggttgaggatccccaggaagatgctgcccaaaaga

SEQ ID NO: 8391 - DNA, 159 bp, Homo sapiens
gaaagtgtttgcaatgggctgggcacatggtggatgtttaataattcatggttgcaatmacacaatgtcagtccctggtcactgggagtcatcatgtgccctgacttggggcctggccctctgcctctgtcttgcaggacaatgccattctctgtctca

SEQ ID NO: 8392 - DNA, 201 bp, Homo sapiens
tgtcagtccctggtcactgggagtcatcatgtgccctgacttggggcctggccctctgcctctgtcttgcaggacaatgccattctctgtctcatggggcrtcctcctgctggcaggcctgtgctgcctggtccccagctccctggttgaggatccccaggaagatgctgcccaaaagacggatacatcccaccatgatca

SEQ ID NO: 8393 - DNA, 185 bp, Homo sapiens
gaaagtgtttgcaatgggctgggcacatggtggatgtttaataattcatggttgcaatcacacaatgtcagtccctggtcactgkgagtcatcatgtgccctgacttggggcctggccctctgcctctgtcttgcaggacaatgccattctctgtctcatggggcgtcctcctgctggcaggcct

SEQ ID NO: 8394 - DNA, 201 bp, Homo sapiens
tcagtccctggtcactgggagtcatcatgtgccctgacttggggcctggccctctgcctctgtcttgcaggacaatgccattctctgtctcatggggcgtmctcctgctggcaggcctgtgctgcctggtccccagctccctggttgaggatccccaggaagatgctgcccaaaagacggatacatcccaccatgatcaag

SEQ ID NO: 8395 - DNA, 201 bp, Homo sapiens
ccaacaagcgtggctatggcctttgcaatgctctccctggggaccaaggctgacactcgcacagagatcctggaaggcctgaatgtcaacctcacagagaygcctgaggccaagatccacgaatgcttccagcaagttctccaagccctcagcaggccagacacccggctccagctgaccaccggcagtagcctgtttgtt

SEQ ID NO: 8396 - DNA, 201 bp, Homo sapiens
ggaccaaggctgacactcgcacagagatcctggaaggcctgaatgtcaacctcacagagacgcctgaggccaagatccacgaatgcttccagcaagttctycaagccctcagcaggccagacacccggctccagctgaccaccggcagtagcctgtttgttaacaagagtatgaagctagtggacacgtttttggaggata

SEQ ID NO: 8397 - DNA, 201 bp, Homo sapiens
caggcctgtgctgcctggtccccagctccctggttgaggatccccaggaagatgctgcccaaaagacggatacatcccaccatgatcaaggggactgggargaccttgcttgccagaagatctcctataacgtcaccgacctcgcctttgatttgtacaaagagctggctgatctatcacaaaccagcaatgtcttagtca

SEQ ID NO: 8398 - DNA, 201 bp, Homo sapiens
acctgaaaaaagacacaagtcttgccctggtggattacatttcctttcacggcaagtggaaagataaattcaaggctgagcgcattatggtagagggcttycatgtggatgataagaccatcatcagagtgcctatgataaaccacctgggtagatttgacatccaccgggacagggagttatccagctgggtgctggcac

SEQ ID NO: 8399 - DNA, 201 bp, Homo sapiens
aaggtctatcaatctacattttcccaaactgtccatttctggaacctacaaactcaagagagtccttaggaatctgggcatcaccaagatcttcagcaacraggccgacctctctggagtcagtcaggaggcacccctgaagctctccaaggctgtgcatgtggctgtgctcaccattgatgagaaagggaccgaagccac

SEQ ID NO: 8400 - DNA, 201 bp, Homo sapiens
aagagctggctgatctatcacaaaccagcaatgtcttagtcaccccaacaagcgtggctatggcctttgcaatgctctccctggggaccaaggctgacackcgcacagagatcctggaaggcctgaatgtcaacctcacagagacgcctgaggccaagatccacgaatgcttccagcaagttctccaagccctcagcaggc

SEQ ID NO: 8401 - DNA, 201 bp, Homo sapiens
accttgcttgccagaagatctcctataacgtcaccgacctcgcctttgatttgtacaaagagctggctgatctatcacaaaccagcaatgtcttagtcacyccaacaagcgtggctatggcctttgcaatgctctccctggggaccaaggctgacactcgcacagagatcctggaaggcctgaatgtcaacctcacagaga

SEQ ID NO: 8402 - DNA, 201 bp, Homo sapiens
agccaccttgaaaatatccagagagcctttgacataaggtctatcaatctacattttcccaaactgtccatttctggaacctacaaactcaagagagtccytaggaatctgggcatcaccaagatcttcagcaacaaggccgacctctctggagtcagtcaggaggcacccctgaagctctccaaggctgtgcatgtggct

SEQ ID NO: 8403 - DNA, 201 bp, Homo sapiens
tccaacgactccttcctgcttcctggacaggactatggctgtgcagggatcccagagaagacttctgggctccctcaactccacccccacagccatccccyagctggggctggctgccaaccagacaggagcccggtgcctggaggtgtccatctctgacgggctcttcctcagcctggggctggtgagcttggtggagaa

SEQ ID NO: 8404 - DNA, 201 bp, Homo sapiens
cgggctgcggtgctgcagcagctggacaatgtcattgacgtgatcacctgcagctccatgctgtccagcctctgcttcctgggcgccatcgccgtggaccrctacatctccatcttctacgcactgcgctaccacagcatcgtgaccctgccgcgggcgcggcgagccgttgcggccatctgggtggccagtgtcgtcttc

SEQ ID NO: 8405 - DNA, 201 bp, Homo sapiens
ggccgccctcagtgggaggggctctgagaacgactttttaaaacgcagagaaaagctccattcttcccaggacctcagcgcagccctggcccaggaaggcrggagacagaggccaggacggtccagaggtgtcgaaatgtcctggggacctgagcagcagccaccagggaagaggcagggagggagctgaggaccaggctt

SEQ ID NO: 8406 - DNA, 201 bp, Homo sapiens
tctcacactcatcgtcctctgccccgagcaccccacgtgcggctgcatcttcaagaacttcaacctctttctcgccctcatcatctgcaatgccatcatcsaccccctcatctacgccttccacagccaggagctccgcaggacgctcaaggaggtgctgacatgctcctggtgagcgcggtgcacgcggctttaagtgtg

SEQ ID NO: 8407 - DNA, 201 bp, Homo sapiens
ggcgctgtcaccctcaccatcctgctgggcattttcttcctctgctggggccccttcttcctgcatctcacactcatcgtcctctgccccgagcaccccaygtgcggctgcatcttcaagaacttcaacctctttctcgccctcatcatctgcaatgccatcatcgaccccctcatctacgccttccacagccaggagctc

SEQ ID NO: 8408 - DNA, 201 bp, Homo sapiens
tgtactgcttcatctgctgcctggccttgtcggacctgctggtgagcgggagcaacgtgctggagacggccgtcatcctcctgctggaggccggtgcactrgtggcccgggctgcggtgctgcagcagctggacaatgtcattgacgtgatcacctgcagctccatgctgtccagcctctgcttcctgggcgccatcgccg

SEQ ID NO: 8409 - DNA, 201 bp, Homo sapiens
ctggtgagcttggtggagaacgcgctggtggtggccaccatcgccaagaaccggaacctgcactcacccatgtactgcttcatctgctgcctggccttgtyggacctgctggtgagcgggagcaacgtgctggagacggccgtcatcctcctgctggaggccggtgcactggtggcccgggctgcggtgctgcagcagctg

SEQ ID NO: 8410 - DNA, 201 bp, Homo sapiens
ctttttaaaacgcagagaaaagctccattcttcccaggacctcagcgcagccctggcccaggaaggcaggagacagaggccaggacggtccagaggtgtcraaatgtcctggggacctgagcagcagccaccagggaagaggcagggagggagctgaggaccaggcttggttgtgagaatccctgagcccaggcggtagat

SEQ ID NO: 8411 - DNA, 201 bp, Homo sapiens
agcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggccct

SEQ ID NO: 8412 - DNA, 201 bp, Homo sapiens
gtaaaggagatccgcggtgtgagggaccccctgggtcctgcacgccgcctggtggcaggccgggccatggtgggtgctcacgcccccggcatgtggccgcyctcagtgggaggggctctgagaacgactttttaaaacgcagagaaaagctccattcttcccaggacctcagcgcagccctggcccaggaaggcaggagac

SEQ ID NO: 8413 - DNA, 201 bp, Homo sapiens
gccccgagcaccccacgtgcggctgcatcttcaagaacttcaacctctttctcgccctcatcatctgcaatgccatcatcgaccccctcatctacgccttycacagccaggagctccgcaggacgctcaaggaggtgctgacatgctcctggtgagcgcggtgcacgcggctttaagtgtgctgggcagagggaggtggtg

SEQ ID NO: 8414 - DNA, 201 bp, Homo sapiens
gcaatgccatcatcgaccccctcatctacgccttccacagccaggagctccgcaggacgctcaaggaggtgctgacatgctcctggtgagcgcggtgcacrcggctttaagtgtgctgggcagagggaggtggtgatattgtgtggtctggttcctgtgtgaccctgggcagttccttacctccctggtccccgtttgtca

SEQ ID NO: 8415 - DNA, 201 bp, Homo sapiens
ggcaggtcccggggaagctccggactcctagaggggcggccaggtgggggccctggtgaccaggacagactgtggtgttttttaacgtaaaggagatccgyggtgtgagggaccccctgggtcctgcacgccgcctggtggcaggccgggccatggtgggtgctcacgcccccggcatgtggccgccctcagtgggagggg

SEQ ID NO: 8416 - DNA, 201 bp, Homo sapiens
ggctgccaaccagacaggagcccggtgcctggaggtgtccatctctgacgggctcttcctcagcctggggctggtgagcttggtggagaacgcgctggtgktggccaccatcgccaagaaccggaacctgcactcacccatgtactgcttcatctgctgcctggccttgtcggacctgctggtgagcgggagcaacgtgct

SEQ ID NO: 8417 - DNA, 201 bp, Homo sapiens
gggctccctcaactccacccccacagccatcccccagctggggctggctgccaaccagacaggagcccggtgcctggaggtgtccatctctgacgggctcytcctcagcctggggctggtgagcttggtggagaacgcgctggtggtggccaccatcgccaagaaccggaacctgcactcacccatgtactgcttcatctg

SEQ ID NO: 8418 - DNA, 201 bp, Homo sapiens
cacgcccgactgctgtgaacggcctgcggagcaccacgtgcgacggctggaggcgagaggtctgcctttgatgtggctgttggtgcagggcctgtggtgcsttccgcagcggaaatggcgcgccgcccggggagggcgggagcagcgtcccgggtgcccctgtgaggatgagcgacgagatgactggagggtccctgaaga

SEQ ID NO: 8419 - DNA, 201 bp, Homo sapiens
tgagcttggtggagaacgcgctggtggtggccaccatcgccaagaaccggaacctgcactcacccatgtactgcttcatctgctgcctggccttgtcggamctgctggtgagcgggagcaacgtgctggagacggccgtcatcctcctgctggaggccggtgcactggtggcccgggctgcggtgctgcagcagctggaca

SEQ ID NO: 8420 - DNA, 201 bp, Homo sapiens
gctggtggtggccaccatcgccaagaaccggaacctgcactcacccatgtactgcttcatctgctgcctggccttgtcggacctgctggtgagcgggagcracgtgctggagacggccgtcatcctcctgctggaggccggtgcactggtggcccgggctgcggtgctgcagcagctggacaatgtcattgacgtgatcac

SEQ ID NO: 8421 - DNA, 201 bp, Homo sapiens
aggcagcgcccggtccaccagggctttggccttaaaggcgctgtcaccctcaccatcctgctgggcattttcttcctctgctggggccccttcttcctgcmtctcacactcatcgtcctctgccccgagcaccccacgtgcggctgcatcttcaagaacttcaacctctttctcgccctcatcatctgcaatgccatcatc

SEQ ID NO: 8422 - DNA, 201 bp, Homo sapiens
gtgatcacctgcagctccatgctgtccagcctctgcttcctgggcgccatcgccgtggaccgctacatctccatcttctacgcactgcgctaccacagcaycgtgaccctgccgcgggcgcggcgagccgttgcggccatctgggtggccagtgtcgtcttcagcacgctcttcatcgcctactacgaccacgtggccgtc

SEQ ID NO: 8423 - DNA, 201 bp, Homo sapiens
cttcagcacagacgcagtcttcagcaaggaagtgctgggaacgccctggagtgaacccaggaagatgcctgcagtgggtgccagggcccctccccaccgtycctgctgggcttcggggccacgcccgactgctgtgaacggcctgcggagcaccacgtgcgacggctggaggcgagaggtctgcctttgatgtggctgttg

SEQ ID NO: 8424 - DNA, 201 bp, Homo sapiens
tttactgtaccagtaaatatgaaaaatattaatgtcctcacacacatggaggtggcttgtgagtggtgtgagcatttcatggtcagagtttggcagttggrcgagagacaggatggattttaactcgaacatcgcagacacaaaactgaaaaccctgatgcggtgcctgcaccgttgcctcctttcctgcagctgtaaatg

SEQ ID NO: 8425 - DNA, 201 bp, Homo sapiens
actaaagatttataaattgtaaaatgcggttgtaacaagtatttactgtaccagtaaatatgaaaaatattaatgtcctcacacacatggaggtggcttgwgagtggtgtgagcatttcatggtcagagtttggcagttgggcgagagacaggatggattttaactcgaacatcgcagacacaaaactgaaaaccctgatg

SEQ ID NO: 8426 - DNA, 153 bp, Homo sapiens
ggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgta

SEQ ID NO: 8427 - DNA, 201 bp, Homo sapiens
cagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggc

SEQ ID NO: 8428 - DNA, 201 bp, Homo sapiens
ctcacccatgtactgcttcatctgctgcctggccttgtcggacctgctggtgagcgggagcaacgtgctggagacggccgtcatcctcctgctggaggccrgtgcactggtggcccgggctgcggtgctgcagcagctggacaatgtcattgacgtgatcacctgcagctccatgctgtccagcctctgcttcctgggcgc

SEQ ID NO: 8429 - DNA, 201 bp, Homo sapiens
acacccccacagccccagggctgcagctgagggggtcgccactctggctgggcgaggctgggcccttgggggcaggcgccagagtggcctcaggctctacragatgcctgaaaacaccaacctctccagggctcactagcattggacgctttcacgctctgccctggccggaagccccctcaccccgcgcgatgtgcaaac

SEQ ID NO: 8430 - DNA, 201 bp, Homo sapiens
ggtggtgatattgtgtggtctggttcctgtgtgaccctgggcagttccttacctccctggtccccgtttgtcaaagaggatggactaaatgatctctgaargtgttgaagcgcggacccttctgggtccagggaggggtccctgcaaaactccaggcaggacttctcaccagcagtcgtggggaacggaggaggacatggg

SEQ ID NO: 8431 - DNA, 201 bp, Homo sapiens
acctctttctcgccctcatcatctgcaatgccatcatcgaccccctcatctacgccttccacagccaggagctccgcaggacgctcaaggaggtgctgacrtgctcctggtgagcgcggtgcacgcggctttaagtgtgctgggcagagggaggtggtgatattgtgtggtctggttcctgtgtgaccctgggcagttcct

SEQ ID NO: 8432 - DNA, 201 bp, Homo sapiens
caatgtcattgacgtgatcacctgcagctccatgctgtccagcctctgcttcctgggcgccatcgccgtggaccgctacatctccatcttctacgcactgygctaccacagcatcgtgaccctgccgcgggcgcggcgagccgttgcggccatctgggtggccagtgtcgtcttcagcacgctcttcatcgcctactacga

SEQ ID NO: 8433 - DNA, 201 bp, Homo sapiens
ggtggtggccaccatcgccaagaaccggaacctgcactcacccatgtactgcttcatctgctgcctggccttgtcggacctgctggtgagcgggagcaacrtgctggagacggccgtcatcctcctgctggaggccggtgcactggtggcccgggctgcggtgctgcagcagctggacaatgtcattgacgtgatcacctg

SEQ ID NO: 8434 - DNA, 201 bp, Homo sapiens
gtcgaaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaagg

SEQ ID NO: 8435 - DNA, 201 bp, Homo sapiens
atcgccgtggaccgctacatctccatcttctacgcactgcgctaccacagcatcgtgaccctgccgcgggcgcggcgagccgttgcggccatctgggtggmcagtgtcgtcttcagcacgctcttcatcgcctactacgaccacgtggccgtcctgctgtgcctcgtggtcttcttcctggctatgctggtgctcatggcc

SEQ ID NO: 8436 - DNA, 201 bp, Homo sapiens
ctccatgctgtccagcctctgcttcctgggcgccatcgccgtggaccgctacatctccatcttctacgcactgcgctaccacagcatcgtgaccctgccgygggcgcggcgagccgttgcggccatctgggtggccagtgtcgtcttcagcacgctcttcatcgcctactacgaccacgtggccgtcctgctgtgcctcgt

SEQ ID NO: 8437 - DNA, 201 bp, Homo sapiens
ggagatccgcggtgtgagggaccccctgggtcctgcacgccgcctggtggcaggccgggccatggtgggtgctcacgcccccggcatgtggccgccctcartgggaggggctctgagaacgactttttaaaacgcagagaaaagctccattcttcccaggacctcagcgcagccctggcccaggaaggcaggagacagagg

SEQ ID NO: 8438 - DNA, 201 bp, Homo sapiens
ggggccctggtgaccaggacagactgtggtgttttttaacgtaaaggagatccgcggtgtgagggaccccctgggtcctgcacgccgcctggtggcaggcygggccatggtgggtgctcacgcccccggcatgtggccgccctcagtgggaggggctctgagaacgactttttaaaacgcagagaaaagctccattcttcc

SEQ ID NO: 8439 - DNA, 201 bp, Homo sapiens
cttccacccttcagcacagacgcagtcttcagcaaggaagtgctgggaacgccctggagtgaacccaggaagatgcctgcagtgggtgccagggcccctcyccaccgtccctgctgggcttcggggccacgcccgactgctgtgaacggcctgcggagcaccacgtgcgacggctggaggcgagaggtctgcctttgatgt

SEQ ID NO: 8440 - DNA, 201 bp, Homo sapiens
tggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgcca

SEQ ID NO: 8441 - DNA, 201 bp, Homo sapiens
gtctggttcctgtgtgaccctgggcagttccttacctccctggtccccgtttgtcaaagaggatggactaaatgatctctgaaagtgttgaagcgcggacmcttctgggtccagggaggggtccctgcaaaactccaggcaggacttctcaccagcagtcgtggggaacggaggaggacatggggaggttgtggggcctca

SEQ ID NO: 8442 - DNA, 201 bp, Homo sapiens
cctctttctcgccctcatcatctgcaatgccatcatcgaccccctcatctacgccttccacagccaggagctccgcaggacgctcaaggaggtgctgacaygctcctggtgagcgcggtgcacgcggctttaagtgtgctgggcagagggaggtggtgatattgtgtggtctggttcctgtgtgaccctgggcagttcctt

SEQ ID NO: 8443 - DNA, 201 bp, Homo sapiens
tgcatcttcaagaacttcaacctctttctcgccctcatcatctgcaatgccatcatcgaccccctcatctacgccttccacagccaggagctccgcaggaygctcaaggaggtgctgacatgctcctggtgagcgcggtgcacgcggctttaagtgtgctgggcagagggaggtggtgatattgtgtggtctggttcctgt

SEQ ID NO: 8444 - DNA, 201 bp, Homo sapiens
catcgcctactacgaccacgtggccgtcctgctgtgcctcgtggtcttcttcctggctatgctggtgctcatggccgtgctgtacgtccacatgctggccygggcctgccagcacgcccagggcatcgcccggctccacaagaggcagcgcccggtccaccagggctttggccttaaaggcgctgtcaccctcaccatcct

SEQ ID NO: 8445 - DNA, 201 bp, Homo sapiens
tgggcgccatcgccgtggaccgctacatctccatcttctacgcactgcgctaccacagcatcgtgaccctgccgcgggcgcggcgagccgttgcggccatytgggtggccagtgtcgtcttcagcacgctcttcatcgcctactacgaccacgtggccgtcctgctgtgcctcgtggtcttcttcctggctatgctggtgc

SEQ ID NO: 8446 - DNA, 201 bp, Homo sapiens
tccagcctctgcttcctgggcgccatcgccgtggaccgctacatctccatcttctacgcactgcgctaccacagcatcgtgaccctgccgcgggcgcggcragccgttgcggccatctgggtggccagtgtcgtcttcagcacgctcttcatcgcctactacgaccacgtggccgtcctgctgtgcctcgtggtcttcttc

SEQ ID NO: 8447 - DNA, 201 bp, Homo sapiens
ccggctccacaagaggcagcgcccggtccaccagggctttggccttaaaggcgctgtcaccctcaccatcctgctgggcattttcttcctctgctggggcyccttcttcctgcatctcacactcatcgtcctctgccccgagcaccccacgtgcggctgcatcttcaagaacttcaacctctttctcgccctcatcatctg

SEQ ID NO: 8448 - DNA, 201 bp, Homo sapiens
tgtacgtccacatgctggcccgggcctgccagcacgcccagggcatcgcccggctccacaagaggcagcgcccggtccaccagggctttggccttaaaggygctgtcaccctcaccatcctgctgggcattttcttcctctgctggggccccttcttcctgcatctcacactcatcgtcctctgccccgagcaccccacgt

SEQ ID NO: 8449 - DNA, 201 bp, Homo sapiens
gcgagccgttgcggccatctgggtggccagtgtcgtcttcagcacgctcttcatcgcctactacgaccacgtggccgtcctgctgtgcctcgtggtcttcytcctggctatgctggtgctcatggccgtgctgtacgtccacatgctggcccgggcctgccagcacgcccagggcatcgcccggctccacaagaggcagcg

SEQ ID NO: 8450 - DNA, 201 bp, Homo sapiens
gctggtgagcttggtggagaacgcgctggtggtggccaccatcgccaagaaccggaacctgcactcacccatgtactgcttcatctgctgcctggccttgycggacctgctggtgagcgggagcaacgtgctggagacggccgtcatcctcctgctggaggccggtgcactggtggcccgggctgcggtgctgcagcagct

SEQ ID NO: 8451 - DNA, 201 bp, Homo sapiens
tccatgctgtccagcctctgcttcctgggcgccatcgccgtggaccgctacatctccatcttctacgcactgcgctaccacagcatcgtgaccctgccgcrggcgcggcgagccgttgcggccatctgggtggccagtgtcgtcttcagcacgctcttcatcgcctactacgaccacgtggccgtcctgctgtgcctcgtg

SEQ ID NO: 8452 - DNA, 201 bp, Homo sapiens
catcgccgtggaccgctacatctccatcttctacgcactgcgctaccacagcatcgtgaccctgccgcgggcgcggcgagccgttgcggccatctgggtgkccagtgtcgtcttcagcacgctcttcatcgcctactacgaccacgtggccgtcctgctgtgcctcgtggtcttcttcctggctatgctggtgctcatggc

SEQ ID NO: 8453 - DNA, 201 bp, Homo sapiens
gatcacctgcagctccatgctgtccagcctctgcttcctgggcgccatcgccgtggaccgctacatctccatcttctacgcactgcgctaccacagcatcstgaccctgccgcgggcgcggcgagccgttgcggccatctgggtggccagtgtcgtcttcagcacgctcttcatcgcctactacgaccacgtggccgtcct

SEQ ID NO: 8454 - DNA, 201 bp, Homo sapiens
tgctgcctggccttgtcggacctgctggtgagcgggagcaacgtgctggagacggccgtcatcctcctgctggaggccggtgcactggtggcccgggctgyggtgctgcagcagctggacaatgtcattgacgtgatcacctgcagctccatgctgtccagcctctgcttcctgggcgccatcgccgtggaccgctacatc

SEQ ID NO: 8455 - DNA, 201 bp, Homo sapiens
tcattgacgtgatcacctgcagctccatgctgtccagcctctgcttcctgggcgccatcgccgtggaccgctacatctccatcttctacgcactgcgctamcacagcatcgtgaccctgccgcgggcgcggcgagccgttgcggccatctgggtggccagtgtcgtcttcagcacgctcttcatcgcctactacgaccacg

SEQ ID NO: 8456 - DNA, 201 bp, Homo sapiens
gagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtgatattcactgaatggccactgtgtgcctgg

SEQ ID NO: 8457 - DNA, 126 bp, Homo sapiens
tataatgtgacaagataacataatgaaaaagaatgaagaataaaatagaaaagtaaaatggattgcatgtcacttgatgacaagtactgtggaatgaggcygtcatctaaatggagcacagaaagt

SEQ ID NO: 8458 - DNA, 115 bp, Homo sapiens
aagataacataatgaaaaagaatgaagaataaaatagaaaagtaaaatggattgcatgtcacttgatgacaagtactgtggaatgaggccgtcatctaaayggagcacagaaagt

SEQ ID NO: 8459 - DNA, 113 bp, Homo sapiens
atgagcctgggtrcacaaaatggtagagcagctcagagagagatggacagacagcatgaacctctgaggagtcaggttttcttggatgaagggacactaagatggctttggag

SEQ ID NO: 8460 - DNA, 201 bp, Homo sapiens
actgactgatcactctcatcagtggcagattttggtgtaacataggacacatcactcccaattcaggtcaagtcccaattatcttgcctctcaatatgacmtgttcaatgttgtatttcattctacttcattttaatgtaaaaagtcttttctggtgaagtcagtcttttattttctcataaaaattcaccctttgggttt

SEQ ID NO: 8461 - DNA, 201 bp, Homo sapiens
tgctgaaagctgaacactcaatgggaagacctgtttgcagagaggagccagccactccagggtctcctttctgctagaagctgaacactcgttgggacacmcttgctgtggaaaggacatccttactgtggaaatgagctactaactgcaggagctgaggagctgcacagcaaggttaaaagagctgtaacacaaacaggg

SEQ ID NO: 8462 - DNA, 201 bp, Homo sapiens
aatgtaaaaagtcttttctggtgaagtcagtcttttattttctcataaaaattcaccctttgggtttttcatagggtattcccataaccaaacacactttrcactttcctagtacataacccaatactttcttctttccccacagtccttacatgaagcctactcagaccgacatcactgtatcatttttttgtattctga

SEQ ID NO: 8463 - DNA, 201 bp, Homo sapiens
ggagagaaactacccattccagaacctcctctctgctgaaagctgaacactcaatgggaagacctgtttgcagagaggagccagccactccagggtctcckttctgctagaagctgaacactcgttgggacacacttgctgtggaaaggacatccttactgtggaaatgagctactaactgcaggagctgaggagctgcac

SEQ ID NO: 8464 - DNA, 201 bp, Homo sapiens
tttattgaatgaacaggaaacagggaaagacattgaccagaaaaagtgtttattcatcaagtctttaaagatacaaaaacacgtgtcttctgtggagctcwgagaacaggactccagcaaagcacttttcagccttgtggtcttcaagcatttccaagatctgtgacattggaaagaaaaaaaattaagacagatttgggt

SEQ ID NO: 8465 - DNA, 201 bp, Homo sapiens
ttttcagccttgtggtcttcaagcatttccaagatctgtgacattggaaagaaaaaaaattaagacagatttgggtctccatgagcagagagtattctttsccttagttctgggtagcatagtgcccaaggaaacctaatcagtacagtgggaaaccaaatctattccaaatcattacccataagcaatcctatggactct

SEQ ID NO: 8466 - DNA, 201 bp, Homo sapiens
gacatcagacatcaatcagatgttgtgagaactgatttctgcatcagaatatctccttgactttacagctatcctttaatcctggctcaaagttccagaaraaagatgatccaatataatactcctatttggactttgagtcatacacattccttcttctgagaaaacgtgcttctgcatgaatcctcccttcattatttt

SEQ ID NO: 8467 - DNA, 201 bp, Homo sapiens
caatgatatttattgaatgaacaggaaacagggaaagacattgaccagaaaaagtgtttattcatcaagtctttaaagatacaaaaacacgtgtcttctgkggagctctgagaacaggactccagcaaagcacttttcagccttgtggtcttcaagcatttccaagatctgtgacattggaaagaaaaaaaattaagacag

SEQ ID NO: 8468 - DNA, 201 bp, Homo sapiens
aagaaaaaaaattaagacagatttgggtctccatgagcagagagtattctttcccttagttctgggtagcatagtgcccaaggaaacctaatcagtacagwgggaaaccaaatctattccaaatcattacccataagcaatcctatggactctctgaggtttgacagagtcagcggccctctccaataaatgtgtttttct

SEQ ID NO: 8469 - DNA, 201 bp, Homo sapiens
cttctgcatgaatcctcccttcattattttcagctcatctattattgaatctgaaaccccaggttaactgactgatcactctcatcagtggcagattttgktgtaacataggacacatcactcccaattcaggtcaagtcccaattatcttgcctctcaatatgacctgttcaatgttgtatttcattctacttcatttta

SEQ ID NO: 8470 - DNA, 201 bp, Homo sapiens
aacatgccccttgctccccacagggagagaagagctctggccctcggagaagcccagacctgggagctccttgagcccgggctgtgactccctctttgggkccctggttggcgtcactgcattcgccagtgccactgttggaagctgcttgtgatgcgcctggtccagggggaagctgtttgttgtgtgcctggtccagcc

SEQ ID NO: 8471 - DNA, 201 bp, Homo sapiens
actcaatgggaagacctgtttgcagagaggagccagccactccagggtctcctttctgctagaagctgaacactcgttgggacacacttgctgtggaaagracatccttactgtggaaatgagctactaactgcaggagctgaggagctgcacagcaaggttaaaagagctgtaacacaaacagggctgcaacatgcccct

SEQ ID NO: 8472 - DNA, 201 bp, Homo sapiens
attgaatgaacaggaaacagggaaagacattgaccagaaaaagtgtttattcatcaagtctttaaagatacaaaaacacgtgtcttctgtggagctctgaraacaggactccagcaaagcacttttcagccttgtggtcttcaagcatttccaagatctgtgacattggaaagaaaaaaaattaagacagatttgggtctc

SEQ ID NO: 8473 - DNA, 201 bp, Homo sapiens
tttgggttaaatggaggttgctaagtggagagtgctaagtagaaatgttatataaactacatactctttacaaatagtagcggtcctgtccagcccactgmcactggaccacatctgtatttaagtcctaaataaaccctatgtcccattcactggctctgggtctcttcttggacaaggcgccatccctgttggaatcaa

SEQ ID NO: 8474 - DNA, 201 bp, Homo sapiens
gccaacccagagagattcacttcttatctgtgaaggacacttgaactccctgcctgtccgttggaactcaggatgtgcaaggaaccaaggccttttatttkgggttaaatggaggttgctaagtggagagtgctaagtagaaatgttatataaactacatactctttacaaatagtagcggtcctgtccagcccactgcca

SEQ ID NO: 8475 - DNA, 201 bp, Homo sapiens
ctaattgaggacaagaatagacctcgtttctatgggcaacaggcatattctgctccctatttcattatttcgcttaaaaaacacttggtgaagacttgatscagattgtcctcttggaatctctgatcctgatgtttatttaagtggcagagtggtggcttttccatggtatatagtcagattcttttttttttttttttg

SEQ ID NO: 8476 - DNA, 201 bp, Homo sapiens
taaattatatcaattatatctcaataaagctgttgaaatttttaaagggcctgacctgtcctggaatggggaaaaacttaatgtgacaaaaatgtaggttrtagtgaagggaacaggaaatggtactgggaccatttttactccagctaaaaaatttgaatttaagaaatttggatatagataggaaggagctaatgttaa

SEQ ID NO: 8477 - DNA, 201 bp, Homo sapiens
acattaggggtggaggacctagggtcataaggttgcccgtggcgacttggagtgaagtgttgagatgatatgcccatttcatggggagaagtagaaagaasagaaaaaccacttttactttagttctggtgtaactatgaagaaaaaaaagcctaattgaggacaagaatagacctcgtttctatgggcaacaggcatatt

SEQ ID NO: 8478 - DNA, 201 bp, Homo sapiens
aaaaaatttgaatttaagaaatttggatatagataggaaggagctaatgttaagcaggaagtaagttgataagagttttctgttaaatgtgatggcaaagyggtaggtgagtatgggctccagtgggacagaacttgtggcagagaaaccaggtcaaaagttaaagttggatttggtgagtaattaaagagagtagtagca

SEQ ID NO: 8479 - DNA, 201 bp, Homo sapiens
accctatgtcccattcactggctctgggtctcttcttggacaaggcgccatccctgttggaatcaatagggctccagcatgacacatgtgcaggatttttwaaattatatcaattatatctcaataaagctgttgaaatttttaaagggcctgacctgtcctggaatggggaaaaacttaatgtgacaaaaatgtaggtta

SEQ ID NO: 8480 - DNA, 201 bp, Homo sapiens
agggctccagcatgacacatgtgcaggattttttaaattatatcaattatatctcaataaagctgttgaaatttttaaagggcctgacctgtcctggaatrgggaaaaacttaatgtgacaaaaatgtaggttatagtgaagggaacaggaaatggtactgggaccatttttactccagctaaaaaatttgaatttaagaa

SEQ ID NO: 8481 - DNA, 201 bp, Homo sapiens; identical to SEQ ID NO: 5437

SEQ ID NO: 8482 - DNA, 201 bp, Homo sapiens; identical to SEQ ID NO: 8403

SEQ ID NO: 8483 - DNA, 201 bp, Homo sapiens; identical to SEQ ID NO: 8404

SEQ ID NO: 8484 - DNA, 201 bp, Homo sapiens
tctcacactcatcgtcctctgccccgagcaccccacgtgcggctgcatcttcaagaacttcaacctctttctcgccctcatcatctgcaatgccatcatcsaccccctcatctacgccttccacagccaggagctccgcaggacgctcaaggaggtgctgacatgctcctgctctcaggaccgtgccctcgtcagctggga

SEQ ID NO: 8485 - DNA, 151 bp, Homo sapiens; identical to SEQ ID NO: 5440

SEQ ID NO: 8486 - DNA, 171 bp, Homo sapiens; identical to SEQ ID NO: 5441

SEQ ID NO: 8487 - DNA, 201 bp, Homo sapiens; identical to SEQ ID NO: 8407

SEQ ID NO: 8488 - DNA, 201 bp, Homo sapiens; identical to SEQ ID NO: 8408

SEQ ID NO: 8489 - DNA, 201 bp, Homo sapiens; identical to SEQ ID NO: 8409

SEQ ID NO: 8490 - DNA, 201 bp, Homo sapiens
gccccgagcaccccacgtgcggctgcatcttcaagaacttcaacctctttctcgccctcatcatctgcaatgccatcatcgaccccctcatctacgccttycacagccaggagctccgcaggacgctcaaggaggtgctgacatgctcctgctctcaggaccgtgccctcgtcagctgggatgtgaagtctctgggtggaa

SEQ ID NO: 8491 - DNA, 201 bp, Homo sapiens; identical to SEQ ID NO: 8417

SEQ ID NO: 8492 - DNA, 201 bp, Homo sapiens; identical to SEQ ID NO: 8416

SEQ ID NO: 8493 - DNA, 201 bp, Homo sapiens; identical to SEQ ID NO: 8420

SEQ ID NO: 8494 - DNA, 201 bp, Homo sapiens; identical to SEQ ID NO: 8419

SEQ ID NO: 8495 - DNA, 201 bp, Homo sapiens; identical to SEQ ID NO: 8421

SEQ ID NO: 8496 - DNA, 201 bp, Homo sapiens; identical to SEQ ID NO: 8422

SEQ ID NO: 8497 - DNA, 201 bp, Homo sapiens; identical to SEQ ID NO: 8428

SEQ ID NO: 8498 - DNA, 201 bp, Homo sapiens; identical to SEQ ID NO: 5444

SEQ ID NO: 8499 - DNA, 201 bp, Homo sapiens; identical to SEQ ID NO: 5443

SEQ ID NO: 8500 - DNA, 201 bp, Homo sapiens
acctctttctcgccctcatcatctgcaatgccatcatcgaccccctcatctacgccttccacagccaggagctccgcaggacgctcaaggaggtgctgacrtgctcctgctctcaggaccgtgccctcgtcagctgggatgtgaagtctctgggtggaagtgtgtgccaagagctactcccacagcagccccaggagaagg

SEQ ID NO: 8501 - DNA, 201 bp, Homo sapiens; identical to SEQ ID NO: 8432

SEQ ID NO: 8502 - DNA, 201 bp, Homo sapiens; identical to SEQ ID NO: 8433

SEQ ID NO: 8503 - DNA, 201 bp, Homo sapiens; identical to SEQ ID NO: 8436

SEQ ID NO: 8504 - DNA, 201 bp, Homo sapiens; identical to SEQ ID NO: 8435

SEQ ID NO: 8505 - DNA, 201 bp, Homo sapiens
cctctttctcgccctcatcatctgcaatgccatcatcgaccccctcatctacgccttccacagccaggagctccgcaggacgctcaaggaggtgctgacaygctcctgctctcaggaccgtgccctcgtcagctgggatgtgaagtctctgggtggaagtgtgtgccaagagctactcccacagcagccccaggagaaggg

SEQ ID NO: 8506 - DNA, 201 bp, Homo sapiens
tgcatcttcaagaacttcaacctctttctcgccctcatcatctgcaatgccatcatcgaccccctcatctacgccttccacagccaggagctccgcaggaygctcaaggaggtgctgacatgctcctgctctcaggaccgtgccctcgtcagctgggatgtgaagtctctgggtggaagtgtgtgccaagagctactccca

SEQ ID NO: 8507 - DNA, 201 bp, Homo sapiens; identical to SEQ ID NO: 8446

SEQ ID NO: 8508 - DNA, 201 bp, Homo sapiens; identical to SEQ ID NO: 8445

SEQ ID NO: 8509 - DNA, 201 bp, Homo sapiens; identical to SEQ ID NO: 8447

SEQ ID NO: 8510 - DNA, 201 bp, Homo sapiens; identical to SEQ ID NO: 8444

SEQ ID NO: 8511 - DNA, 201 bp, Homo sapiens; identical to SEQ ID NO: 8448

SEQ ID NO: 8512 - DNA, 201 bp, Homo sapiens; identical to SEQ ID NO: 5442

SEQ ID NO: 8513 - DNA, 201 bp, Homo sapiens; identical to SEQ ID NO: 8450

SEQ ID NO: 8514 - DNA, 201 bp, Homo sapiens; identical to SEQ ID NO: 8449

SEQ ID NO: 8515 - DNA, 201 bp, Homo sapiens; identical to SEQ ID NO: 5445

SEQ ID NO: 8516 - DNA, 201 bp, Homo sapiens; identical to SEQ ID NO: 8452

SEQ ID NO: 8517 - DNA, 201 bp, Homo sapiens; identical to SEQ ID NO: 8451

SEQ ID NO: 8518 - DNA, 201 bp, Homo sapiens; identical to SEQ ID NO: 8453

SEQ ID NO: 8519 - DNA, 201 bp, Homo sapiens; identical to SEQ ID NO: 8454

SEQ ID NO: 8520 - DNA, 201 bp, Homo sapiens; identical to SEQ ID NO: 5438

SEQ ID NO: 8521 - DNA, 201 bp, Homo sapiens; identical to SEQ ID NO: 5439

SEQ ID NO: 8522 - DNA, 201 bp, Homo sapiens; identical to SEQ ID NO: 8455

SEQ ID NO: 8523 - DNA, 201 bp, Homo sapiens
ccgctcagctcctgcccgtgtcattgtggtctcctcagagtcccatcgatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 8524 - DNA, 201 bp, Homo sapiens
gccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggccccttccaaatgtccctccaac

SEQ ID NO: 8525 - DNA, 201 bp, Homo sapiens
tgttttgtgccgctcagctcctgcccgtgtcattgtggtctcctcagagtcccatcgatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 8526 - DNA, 201 bp, Homo sapiens
tgtaggttccgtatctccctggagaagcaccagcaattctctttcttttactgttatagaatagcctgaggtcccctcgtcccatccagctaccaccacgrccaccactgcagccaggggctggccttctcctacttagggaagaaaaagcaagtgttcactgctccttgctgcattgatccaggagataattgtttcatt

SEQ ID NO: 8527 - DNA, 201 bp, Homo sapiens
gctcctccaggatgttttgtgccgctcagctcctgcccgtgtcattgtggtctcctcagagtcccatcgatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 8528 - DNA, 201 bp, Homo sapiens
aagaacggcttggcagccagtccggctaagtggagctcagagcggatgggcacacacacccgccctgtgtgtgtcccctcacgcaagtgccagggctgggycccttccaaatgtccctccaacacagatccgcaagagtaaaggaaataagagcattcacaacagagtgaaaaatcttaagtaccaatgggaagcagggaa

SEQ ID NO: 8529 - DNA, 201 bp, Homo sapiens
tctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaa

SEQ ID NO: 8530 - DNA, 201 bp, Homo sapiens
gggaattcctggggtaaagtatcacttttctggggctgggctaggcataggtctctttgctttctggtggtggcctgtttgaaagtaaaaacctggttggygtgtaggttccgtatctccctggagaagcaccagcaattctctttcttttactgttatagaatagcctgaggtcccctcgtcccatccagctaccaccac

SEQ ID NO: 8531 - DNA, 201 bp, Homo sapiens
aagcagggaattcctggggtaaagtatcacttttctggggctgggctaggcataggtctctttgctttctggtggtggcctgtttgaaagtaaaaacctgsttggcgtgtaggttccgtatctccctggagaagcaccagcaattctctttcttttactgttatagaatagcctgaggtcccctcgtcccatccagctacc

SEQ ID NO: 8532 - DNA, 201 bp, Homo sapiens
gtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggata

SEQ ID NO: 8533 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaatagggttcgaaaccgccaagtcttttgccctccatggtgcacatg

SEQ ID NO: 8534 - DNA, 201 bp, Homo sapiens
caagaaactgatgagaacggacaagtgttttttgttgaccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 8535 - DNA, 201 bp, Homo sapiens
acacccgccctgtgtgtgtcccctcacgcaagtgccagggctgggccccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgc

SEQ ID NO: 8536 - DNA, 201 bp, Homo sapiens
ggacctcgctctgctccgtagcgtgcagcattttgctgaagcattcaaggccaagaatgtgcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 8537 - DNA, 201 bp, Homo sapiens
atcgatttacagatattaacgactccttgggaaaactggacttcagtcgcctctctccaacaaaaaacgactattgggcgatgctggcttataacaggtcsaagctctgcaacatcctcttctccaacgagctgcaccgtcgcctctccccacgcggggtcacgtcgaacgcagtgcatcctggaaatatgatgtactcca

SEQ ID NO: 8538 - DNA, 201 bp, Homo sapiens
ggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggcataaagccaaggtagaaacaatgaccctggacctcgct

SEQ ID NO: 8539 - DNA, 201 bp, Homo sapiens
gtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 8540 - DNA, 201 bp, Homo sapiens
tccctggagaagcaccagcaattctctttcttttactgttatagaatagcctgaggtcccctcgtcccatccagctaccaccacggccaccactgcagccrggggctggccttctcctacttagggaagaaaaagcaagtgttcactgctccttgctgcattgatccaggagataattgtttcattcatcctgaccaagac

SEQ ID NO: 8541 - DNA, 201 bp, Homo sapiens
cggacagtgaggacgagctgcctccgggctgggaggagagaaccaccaaggacggctgggtttactacgccaatcacaccgaggagaagactcagtgggawcatccaaaaactggaaaaagaaaacgagtggcaggagatttgccatacggatgggaacaagaaactgatgagaacggacaagtgttttttgttgaccata

SEQ ID NO: 8542 - DNA, 201 bp, Homo sapiens
agtgaaaaatcttaagtaccaatgggaagcagggaattcctggggtaaagtatcacttttctggggctgggctaggcataggtctctttgctttctggtgstggcctgtttgaaagtaaaaacctggttggcgtgtaggttccgtatctccctggagaagcaccagcaattctctttcttttactgttatagaatagcctg

SEQ ID NO: 8543 - DNA, 201 bp, Homo sapiens
cctccatggtgcacatgtgatcttggcctgcaggaacatggcaagggcgagtgaagcagtgtcacgcattttagaagaatggcataaagccaaggtagaarcaatgaccctggacctcgctctgctccgtagcgtgcagcattttgctgaagcattcaaggccaagaatgtgcctcttcatgtgcttgtgtgcaacgcagc

SEQ ID NO: 8544 - DNA, 201 bp, Homo sapiens
tctccaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcct

SEQ ID NO: 8545 - DNA, 201 bp, Homo sapiens; identical to SEQ ID NO: 8538

SEQ ID NO: 8546 - DNA, 201 bp, Homo sapiens; identical to SEQ ID NO: 8523

SEQ ID NO: 8547 - DNA, 201 bp, Homo sapiens; identical to SEQ ID NO: 8525

SEQ ID NO: 8548 - DNA, 201 bp, Homo sapiens; identical to SEQ ID NO: 8539

SEQ ID NO: 8549 - DNA, 201 bp, Homo sapiens; identical to SEQ ID NO: 8527

SEQ ID NO: 8550 - DNA, 201 bp, Homo sapiens; identical to SEQ ID NO: 8541

SEQ ID NO: 8551 - DNA, 201 bp, Homo sapiens; identical to SEQ ID NO: 8533

SEQ ID NO: 8552 - DNA, 201 bp, Homo sapiens; identical to SEQ ID NO: 8534

SEQ ID NO: 8553 - DNA, 201 bp, Homo sapiens; identical to SEQ ID NO: 8536

SEQ ID NO: 8554 - DNA, 201 bp, Homo sapiens; identical to SEQ ID NO: 8543

SEQ ID NO: 8555 - DNA, 201 bp, Homo sapiens; identical to SEQ ID NO: 8537

SEQ ID NO: 8556 - DNA, 201 bp, Homo sapiens; identical to SEQ ID NO: 8544

SEQ ID NO: 8557 - DNA, 162 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgc

SEQ ID NO: 8558 - DNA, 201 bp, Homo sapiens
cggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgcggcgcggcgagggcaa

SEQ ID NO: 8559 - DNA, 200 bp, Homo sapiens
tcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 8560 - DNA, 201 bp, Homo sapiens
ggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggaaaacaaaataccaccctccgccagaaaagtgcagaata

SEQ ID NO: 8561 - DNA, 201 bp, Homo sapiens; identical to SEQ ID NO: 8533

SEQ ID NO: 8562 - DNA, 201 bp, Homo sapiens; identical to SEQ ID NO: 8534

SEQ ID NO: 8563 - DNA, 201 bp, Homo sapiens; identical to SEQ ID NO: 8539

SEQ ID NO: 8564 - DNA, 201 bp, Homo sapiens; identical to SEQ ID NO: 8541

SEQ ID NO: 8565 - DNA, 201 bp, Homo sapiens
gctcaaggcttaactccaacacgcaaggggagatgaagtttgaggtggaaaacctcatcctacacaaggactacagcgctgacacgcttgctcaccacaaygacattgccttgctgaagatccgttccaaggagggcaggtgtgcgcagccatcccggactatacagaccatctgcctgccctcgatgtataacgatcccc

SEQ ID NO: 8566 - DNA, 201 bp, Homo sapiens
tggttgtcatttttgcagtagagtcatctccatcagctgtaagaagagactgggaagataggctctgcacagatggatttgcctgtgccacccaccagggygaacgacaatagctttaccctcaggcataggcctgggtgctggctgcccagacccctctggccaggatggaggggtggtcctgactcaacatgttactga

SEQ ID NO: 8567 - DNA, 201 bp, Homo sapiens
caaggggagatgaagtttgaggtggaaaacctcatcctacacaaggactacagcgctgacacgcttgctcaccacaacgacattgccttgctgaagatccrttccaaggagggcaggtgtgcgcagccatcccggactatacagaccatctgcctgccctcgatgtataacgatccccagtttggcacaagctgtgagatc

SEQ ID NO: 8568 - DNA, 201 bp, Homo sapiens
cccgctttcttgctggttgtcatttttgcagtagagtcatctccatcagctgtaagaagagactgggaagataggctctgcacagatggatttgcctgtgscacccaccagggtgaacgacaatagctttaccctcaggcataggcctgggtgctggctgcccagacccctctggccaggatggaggggtggtcctgactc

SEQ ID NO: 8569 - DNA, 201 bp, Homo sapiens
agcttagccaatgtgggagcagcggtttggggagcagagacactaacgacttcagggcagggctctgatattccatgaatgtatcaggaaatatatatgtktgtgtatgtttgcacacttgtgtgtgggctgtgagtgtaagtgtgagtaagagctggtgtctgattgttaagtctaaatatttccttaaactgtgtggac

SEQ ID NO: 8570 - DNA, 201 bp, Homo sapiens
ccacagtggaaaacagattcctgccagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctc

SEQ ID NO: 8571 - DNA, 201 bp, Homo sapiens
ctgacaccatgggccggccctgcctgccctggaactctgccactgtccttcagcaaacgtaccatgcccacagatctgatgctcttcagctgggcctgggraaacataattactgcaggaacccagacaaccggaggcgaccctggtgctatgtgcaggtgggcctaaagccgcttgtccaagagtgcatggtgcatgact

SEQ ID NO: 8572 - DNA, 201 bp, Homo sapiens
gctcgcgccctcctgccgcagccaccgagccgccgtctagcgccccgacctcgccaccatgagagccctgctggcgcgcctgcttctctgcgtcctggtcktgagcgactccaaaggcagcaatgaacttcatcaagttccatcgaactgtgactgtctaaatggaggaacatgtgtgtccaacaagtacttctccaacat

SEQ ID NO: 8573 - DNA, 201 bp, Homo sapiens
tcgcagcacagtgcggagaccgcagccccggagcccgggccagggtccacctgtccccgcagcgccggctcgcgccctcctgccgcagccaccgagccgcygtctagcgccccgacctcgccaccatgagagccctgctggcgcgcctgcttctctgcgtcctggtcgtgagcgactccaaaggcagcaatgaacttcatc

SEQ ID NO: 8574 - DNA, 201 bp, Homo sapiens
tctatccggagcagctgaaaatgactgttgtgaagctgatttcccaccgggagtgtcagcagccccactactacggctctgaagtcaccaccaaaatgctrtgtgctgctgacccacagtggaaaacagattcctgccagggagactcagggggacccctcgtctgttccctccaaggccgcatgactttgactggaattg

SEQ ID NO: 8575 - DNA, 201 bp, Homo sapiens
agatctgatgctcttcagctgggcctggggaaacataattactgcaggaacccagacaaccggaggcgaccctggtgctatgtgcaggtgggcctaaagcygcttgtccaagagtgcatggtgcatgactgcgcagatggaaaaaagccctcctctcctccagaagaattaaaatttcagtgtggccaaaagactctgagg

SEQ ID NO: 8576 - DNA, 201 bp, Homo sapiens
ggggagaattcaccaccatcgagaaccagccctggtttgcggccatctacaggaggcaccgggggggctctgtcacctacgtgtgtggaggcagcctcatsagcccttgctgggtgatcagcgccacacactgcttcattgattacccaaagaaggaggactacatcgtctacctgggtcgctcaaggcttaactccaaca

SEQ ID NO: 8577 - DNA, 201 bp, Homo sapiens
acagtgcggagaccgcagccccggagcccgggccagggtccacctgtccccgcagcgccggctcgcgccctcctgccgcagccaccgagccgccgtctagmgccccgacctcgccaccatgagagccctgctggcgcgcctgcttctctgcgtcctggtcgtgagcgactccaaaggcagcaatgaacttcatcaagttcc

SEQ ID NO: 8578 - DNA, 201 bp, Homo sapiens
caggaggcaccgggggggctctgtcacctacgtgtgtggaggcagcctcatcagcccttgctgggtgatcagcgccacacactgcttcattgattacccamagaaggaggactacatcgtctacctgggtcgctcaaggcttaactccaacacgcaaggggagatgaagtttgaggtggaaaacctcatcctacacaagga

SEQ ID NO: 8579 - DNA, 201 bp, Homo sapiens; identical to SEQ ID NO: 8565

SEQ ID NO: 8580 - DNA, 201 bp, Homo sapiens; identical to SEQ ID NO: 8568

SEQ ID NO: 8581 - DNA, 201 bp, Homo sapiens; identical to SEQ ID NO: 8571

SEQ ID NO: 8582 - DNA, 201 bp, Homo sapiens
cctgataactaacctgggagtttcgggagccgccgtctagcgccccgacctcgccaccatgagagccctgctggcgcgcctgcttctctgcgtcctggtcktgagcgactccaaaggcagcaatgaacttcatcaagttccatcgaactgtgactgtctaaatggaggaacatgtgtgtccaacaagtacttctccaacat

SEQ ID NO: 8583 - DNA, 201 bp, Homo sapiens
ccaagtaatctggagtcatgagagctgctaggggagcaacatgaatcatgacggcccctgggaatttcctgataactaacctgggagtttcgggagccgcygtctagcgccccgacctcgccaccatgagagccctgctggcgcgcctgcttctctgcgtcctggtcgtgagcgactccaaaggcagcaatgaacttcatc

SEQ ID NO: 8584 - DNA, 200 bp, Homo sapiens
agcaatcagcatgacagcctccagccaagtaatctggagtcatgagagctgctaggggagcaacatgaatcatgacggcccctgggaatttcctgataaytaacctgggagtttcgggagccgccgtctagcgccccgacctcgccaccatgagagccctgctggcgcgcctgcttctctgcgtcctggtcgtgagcgac

SEQ ID NO: 8585 - DNA, 201 bp, Homo sapiens
atctggagtcatgagagctgctaggggagcaacatgaatcatgacggcccctgggaatttcctgataactaacctgggagtttcgggagccgccgtctagmgccccgacctcgccaccatgagagccctgctggcgcgcctgcttctctgcgtcctggtcgtgagcgactccaaaggcagcaatgaacttcatcaagttcc

SEQ ID NO: 8586 - DNA, 179 bp, Homo sapiens
agcaatcagcatgacagcctccagccaagtaatctggagtcatgagagctgctaggggagcaacatgaatcatgacggyccctgggaatttcctgataactaacctgggagtttcgggagccgccgtctagcgccccgacctcgccaccatgagagccctgctggcgcgcctgcttctc

SEQ ID NO: 8587 - DNA, 201 bp, Homo sapiens; identical to SEQ ID NO: 8566

SEQ ID NO: 8588 - DNA, 201 bp, Homo sapiens; identical to SEQ ID NO: 8567

SEQ ID NO: 8589 - DNA, 201 bp, Homo sapiens; identical to SEQ ID NO: 8569

SEQ ID NO: 8590 - DNA, 201 bp, Homo sapiens; identical to SEQ ID NO: 8570

SEQ ID NO: 8591 - DNA, 146 bp, Homo sapiens
agcaatcagcatgacagcctccagccaagtaatctggagtcatgaragctgctaggggagcaacatgaatcatgacggcccctgggaatttcctgataactaacctgggagtttcgggagccgccgtctagcgccccgacctcgcc

SEQ ID NO: 8592 - DNA, 201 bp, Homo sapiens; identical to SEQ ID NO: 8575

SEQ ID NO: 8593 - DNA, 201 bp, Homo sapiens; identical to SEQ ID NO: 8574

SEQ ID NO: 8594 - DNA, 201 bp, Homo sapiens; identical to SEQ ID NO: 8576

SEQ ID NO: 8595 - DNA, 201 bp, Homo sapiens; identical to SEQ ID NO: 8578

SEQ ID NO: 8596 - DNA, 201 bp, Homo sapiens
cggaactgtgtggatgaaaatgaatgtgcaactggctttcatcgctgtggccccaactctgtatgtatcaacttgcctggaagctacaggtgtgagtgccrgagtggttatgagtttgcagatgaccggcatacttgcatcttgatcaccccacctgccaacccctgtgaggatggcagtcatacctgtgctcctgctggg

SEQ ID NO: 8597 - DNA, 201 bp, Homo sapiens
caccagagcccacccagaggcccccgaccatctgtgagcgctggagggaaaacctgctggagcactacggtggcaccccccgggatgaccagtacgtgccmcagtgcgatgacctgggccacttcatccccctgcagtgccacggaaagagcgacttctgctggtgtgtggacaaagatggcagagaggtgcagggcaccc

SEQ ID NO: 8598 - DNA, 201 bp, Homo sapiens
gggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccactgtgacctctacaagttccagagactactctctgacttt

SEQ ID NO: 8599 - DNA, 201 bp, Homo sapiens
gctgatacctcaatctttactactgtatttttaaaaatgaaggttgttattgcaagtttaaaaaggtaacagaattttaactgttgcttattaaagcaacwtcttgtaaacatttatcattaatatttaaaagatcaaattcattcaactaagaattagagtttaagactctaaacctgatttttgccatggattccttct

SEQ ID NO: 8600 - DNA, 201 bp, Homo sapiens
aattcattcaactaagaattagagtttaagactctaaacctgatttttgccatggattccttctggccaagaaattaaagcacatgtgatcaatataacawtataatcctaaaccttgacagttggagaagccaatgcagaactgatgggaaaggaccaattatttatagtttcccaacaaaagttctaagattttttacc

SEQ ID NO: 8601 - DNA, 201 bp, Homo sapiens
cgttcagctgtgcctgcctgcctggttatgccggcgatgggcaccagtgcactgatgtagatgaatgctcagaaaacagatgtcaccctgcagctacctgytacaatactcctggttccttctcctgccgttgtcaacccggatattatggggatggatttcagtgcatacctgactccacctcaagcctgacaccctgtg

SEQ ID NO: 8602 - DNA, 201 bp, Homo sapiens
tttgctgtgaccaatcaaattggcccggtcaaagaggattcagaccccactccggtgaatccttgctatgatgggagccacatgtgtgacacaacagcacrgtgccatccagggacaggtgtagattacacctgtgagtgcgcatctgggtaccagggagatggacggaactgtgtggatgaaaatgaatgtgcaactggc

SEQ ID NO: 8603 - DNA, 201 bp, Homo sapiens
aggccagctgcagttggagacctttccgctgcccactcttctgttcccctgggacgttccttcagccatgctacagccctggaaagtgactataatgaggrcaatttggattactacgatgtgaatgaggaggaagctgaataccttccgggtgaaccagaggaggcattgaatggccacagcagcattgatgtttccttc

SEQ ID NO: 8604 - DNA, 201 bp, Homo sapiens
tctacgaagcccgattcagcaacctctacgtgggcaccaacggcatcatctccactcaggacttccccagggaaacgcagtatgtggactatgatttcccyaccgacttcccggccatcgccccttttctggcggacatcgacacgagccacggcagaggccgagtcctgtaccgagaggacacctcccccgcagtgctgg

SEQ ID NO: 8605 - DNA, 201 bp, Homo sapiens
aatgaggaggaagctgaataccttccgggtgaaccagaggaggcattgaatggccacagcagcattgatgtttccttccaatccaaagtggatacaaagcmtttagaggaatcttccaccttggatcctcacaccaaagaaggaacatctctgggagaggtagggggcccagatttaaaaggccaagttgagccctgggat

SEQ ID NO: 8606 - DNA, 201 bp, Homo sapiens
gacaatgctcccggcatgccttctgcacggactatgccactggcttctgctgccactgccaatccaagttttatggaaatgggaagcactgtctgcctgarggggcacctcaccgagtgaatgggaaagtgagtggccacctccacgtgggccatacacccgtgcacttcactgatgtggacctgcatgcgtatatcgtgg

SEQ ID NO: 8607 - DNA, 201 bp, Homo sapiens
gagacctttccgctgcccactcttctgttcccctgggacgttccttcagccatgctacagccctggaaagtgactataatgaggacaatttggattactaygatgtgaatgaggaggaagctgaataccttccgggtgaaccagaggaggcattgaatggccacagcagcattgatgtttccttccaatccaaagtggata

SEQ ID NO: 8608 - DNA, 201 bp, Homo sapiens
cactcaggacttccccagggaaacgcagtatgtggactatgatttccccaccgacttcccggccatcgccccttttctggcggacatcgacacgagccacsgcagaggccgagtcctgtaccgagaggacacctcccccgcagtgctgggcctggccgcccgctatgtgcgcgctggcttcccgcgctctgcgcgctttac

SEQ ID NO: 8609 - DNA, 201 bp, Homo sapiens
agaacatcacttaccaggtgtgcaggcacgcccccagacacccgtccttccccaccacccagcagctgaacgtggaccgggtctttgccttgtataatgaygaagaaagagtgcttagatttgctgtgaccaatcaaattggcccggtcaaagaggattcagaccccactccggtgaatccttgctatgatgggagccaca

SEQ ID NO: 8610 - DNA, 201 bp, Homo sapiens
tatgagtttgcagatgaccggcatacttgcatcttgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactgatgtagatgaatgctcagaaaac

SEQ ID NO: 8611 - DNA, 201 bp, Homo sapiens
gaccgggtctttgccttgtataatgacgaagaaagagtgcttagatttgctgtgaccaatcaaattggcccggtcaaagaggattcagaccccactccggkgaatccttgctatgatgggagccacatgtgtgacacaacagcacggtgccatccagggacaggtgtagattacacctgtgagtgcgcatctgggtaccag

SEQ ID NO: 8612 - DNA, 201 bp, Homo sapiens
cctctacaagttccagagactactctctgacttttggtgcaatcaaccaaacatggtcctaccgcatccaccagaacatcacttaccaggtgtgcaggcaygcccccagacacccgtccttccccaccacccagcagctgaacgtggaccgggtctttgccttgtataatgacgaagaaagagtgcttagatttgctgtga

SEQ ID NO: 8613 - DNA, 201 bp, Homo sapiens
tgctgtctctgcatggctccataatcgtgggaattgattacgactgccgggagaggatggtgtactggacagatgttgctggacggacaatcagccgtgcyggtctggaactgggagcagagcctgagacgatcgtgaattcaggtctgataagccctgaaggacttgccatagaccacatccgcagaacaatgtactgga

SEQ ID NO: 8614 - DNA, 201 bp, Homo sapiens
cgcctcactgtggaccatcaccagagcccacccagaggcccccgaccatctgtgagcgctggagggaaaacctgctggagcactacggtggcaccccccgrgatgaccagtacgtgccccagtgcgatgacctgggccacttcatccccctgcagtgccacggaaagagcgacttctgctggtgtgtggacaaagatggca

SEQ ID NO: 8615 - DNA, 201 bp, Homo sapiens
atagtttcccaacaaaagttctaagattttttacctctgcatcagtgcatttctatttatatcaaaaggtgctaaaatgattcaatttgcattttctgatyctgtagtgcctctatagaagtacccacagaaagtaaagtatcacatttataaataccaaagatgtaacaattttaaaattttctagattactccaataaa

SEQ ID NO: 8616 - DNA, 201 bp, Homo sapiens
tcctgcccctacagtgtcatggcagcactggtttctgctggtgcgtggaccctgatggtcatgaagttcctggtacccagactccacctggctccaccccrcctcactgtggaccatcaccagagcccacccagaggcccccgaccatctgtgagcgctggagggaaaacctgctggagcactacggtggcaccccccggg

SEQ ID NO: 8617 - DNA, 201 bp, Homo sapiens
caaccaaacatggtcctaccgcatccaccagaacatcacttaccaggtgtgcaggcacgcccccagacacccgtccttccccaccacccagcagctgaacrtggaccgggtctttgccttgtataatgacgaagaaagagtgcttagatttgctgtgaccaatcaaattggcccggtcaaagaggattcagaccccactcc

SEQ ID NO: 8618 - DNA, 201 bp, Homo sapiens
cctcaatctttactactgtatttttaaaaatgaaggttgttattgcaagtttaaaaaggtaacagaattttaactgttgcttattaaagcaacttcttgtwaacatttatcattaatatttaaaagatcaaattcattcaactaagaattagagtttaagactctaaacctgatttttgccatggattccttctggccaag

SEQ ID NO: 8619 - DNA, 201 bp, Homo sapiens
ttatcattaatatttaaaagatcaaattcattcaactaagaattagagtttaagactctaaacctgatttttgccatggattccttctggccaagaaattwaagcacatgtgatcaatataacaatataatcctaaaccttgacagttggagaagccaatgcagaactgatgggaaaggaccaattatttatagtttccca

SEQ ID NO: 8620 - DNA, 201 bp, Homo sapiens
atccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgaggtcttcacgtataatgctgccaacaaggaa

SEQ ID NO: 8621 - DNA, 201 bp, Homo sapiens
atgatgggagccacatgtgtgacacaacagcacggtgccatccagggacaggtgtagattacacctgtgagtgcgcatctgggtaccagggagatggacgkaactgtgtggatgaaaatgaatgtgcaactggctttcatcgctgtggccccaactctgtatgtatcaacttgcctggaagctacaggtgtgagtgccgga

SEQ ID NO: 8622 - DNA, 201 bp, Homo sapiens
ccacccagcagctgaacgtggaccgggtctttgccttgtataatgacgaagaaagagtgcttagatttgctgtgaccaatcaaattggcccggtcaaagargattcagaccccactccggtgaatccttgctatgatgggagccacatgtgtgacacaacagcacggtgccatccagggacaggtgtagattacacctgtg

SEQ ID NO: 8623 - DNA, 201 bp, Homo sapiens
aagttcctggtacccagactccacctggctccaccccgcctcactgtggaccatcaccagagcccacccagaggcccccgaccatctgtgagcgctggagrgaaaacctgctggagcactacggtggcaccccccgggatgaccagtacgtgccccagtgcgatgacctgggccacttcatccccctgcagtgccacggaa

SEQ ID NO: 8624 - DNA, 201 bp, Homo sapiens
gcgttgtgcagcgggtaagcgcacggccgagcgagcatggagggggaccgggtggccgggcggccggtgctgtcgtcgttaccagtgctactgctgctgcmgttgctaatgttgcgggccgcggcgctgcacccagacgagctcttcccacacggggagtcgtggggggaccagctcctgcaggaaggcgacgacgaaagc

SEQ ID NO: 8625 - DNA, 201 bp, Homo sapiens
ggtgctgtcgtcgttaccagtgctactgctgctgccgttgctaatgttgcgggccgcggcgctgcacccagacgagctcttcccacacggggagtcgtggkgggaccagctcctgcaggaaggcgacgacgaaagctcagccgtggtgaagctggcgaatcccctgcacttctacgaagcccgattcagcaacctctacgt

SEQ ID NO: 8626 - DNA, 201 bp, Homo sapiens
tcagccacatcccacagccagcagcccaggccctcctccccctcacaccaattggaggcctgtttggctggctctttgctttagaaaaacctggctctgakaacggcttcagcctcgcaggtgctgcctttacccatgacatggaagttacattctacccgggagaggagacggttcgtatcactcaaactgctgagggac

SEQ ID NO: 8627 - DNA, 201 bp, Homo sapiens
gaggatgacatgttaaaagaagaaatgaatggattttcatcctttgcaaggtcactagtaccctcttcagagagactacacctaagtctacataaatccartaaagtcatcacaaatggtcctgagaagaactccagttcctccccgtccagtgtggattatgcagcctccgggccccggaaactgagctctggagccctg

SEQ ID NO: 8628 - DNA, 201 bp, Homo sapiens
gccaaagctgcagtagactgctcggttccagtaagcgtgagtaccagcataaagtatgcagaccaacaacgaagagagaaactcaaaaaggaattagcacratgtgaaaaagagttcaaattaactaaaactgcaatgcgagccaattataaaaataattccaagtcactttttaataccttacaaaagccctcaggcgaa

SEQ ID NO: 8629 - DNA, 201 bp, Homo sapiens
cactagtaccctcttcagagagactacacctaagtctacataaatccagtaaagtcatcacaaatggtcctgagaagaactccagttcctccccgtccagygtggattatgcagcctccgggccccggaaactgagctctggagccctgtatggcagaaggcccagaagcacattcccaaattcccaccggtttcagttag

SEQ ID NO: 8630 - DNA, 201 bp, Homo sapiens
acgactgttcgagcgacatataaaacaaaataaacatttggaggaggaaaaaatgcgccacctgctgcatgtcctgaaagtagacttaggctgcacatcgraggaaaactcggtaaagcaaaatgatgttgatatgttgaatgtatttgattttgaaaaggctgggaattcagaaccaaatgaattaaaaaatgaaagtga

SEQ ID NO: 8631 - DNA, 201 bp, Homo sapiens
tcagaaggggttataattcaacaggtgaatgatgaaacaaatcttgaaacttcaactttggatgaaaatcatccaagtatttcagacagtttaacagatcrggaaacttctgtgaatgtcattgaaggtgatagtgaccctgaaaaggttgagatttcaaatggattatgtggtcttaacacatcaccctcccaatctgtt

SEQ ID NO: 8632 - DNA, 201 bp, Homo sapiens
gagagaaactcaaaaaggaattagcacaatgtgaaaaagagttcaaattaactaaaactgcaatgcgagccaattataaaaataattccaagtcacttttkaataccttacaaaagccctcaggcgaaccgcaaattgaggatgacatgttaaaagaagaaatgaatggattttcatcctttgcaaggtcactagtaccct

SEQ ID NO: 8633 - DNA, 129 bp, Homo sapiens
cctgctgctgcagcccccgtcggctcctyttttccagtcctccactgccggggctgggcccggccgcgggaaggaccgaaggggatacagcgtgtccctgcggcggctgcaagaggactaagcatggat

SEQ ID NO: 8634 - DNA, 201 bp, Homo sapiens
ctcttttccagtcctccactgccggggctgggcccggccgcgggaaggaccgaaggggatacagcgtgtccctgcggcggctgcaagaggactaagcatgratggcagccggagagagcaacctctgtccttcccagatatggtccaccgtgcctatttaaaggacacttgagcaccaaaagtaatgctttttgcactgac

SEQ ID NO: 8635 - DNA, 201 bp, Homo sapiens
ccattcactcctcgcactttaaaaacagaagcaaaatctttcctgtcacagtatcgctattatacacctgccaaaagaaaaaaggattttacagatcaacrgatagaagctgaaacccagactgaattaagctttaaatctgagttggggacagctgagactaaaaacatgacagattcagaaatgaacataaagcaggca

SEQ ID NO: 8636 - DNA, 201 bp, Homo sapiens
cagactaagcactctccagctggtcaagaatcacatggctgttcactataataaaatcctttcagccaaagctgcagtagactgctcggttccagtaagcrtgagtaccagcataaagtatgcagaccaacaacgaagagagaaactcaaaaaggaattagcacaatgtgaaaaagagttcaaattaactaaaactgcaat

SEQ ID NO: 8637 - DNA, 201 bp, Homo sapiens
tgctgctgcagcccccgtcggctcctcttttccagtcctccactgccggggctgggcccggccgcgggaaggaccgaaggggatacagcgtgtccctgcgrcggctgcaagaggactaagcatggatggcagccggagagagcaacctctgtccttcccagatatggtccaccgtgcctatttaaaggacacttgagcacc

SEQ ID NO: 8638 - DNA, 201 bp, Homo sapiens; identical to SEQ ID NO: 8627

SEQ ID NO: 8639 - DNA, 201 bp, Homo sapiens; identical to SEQ ID NO: 8628

SEQ ID NO: 8640 - DNA, 201 bp, Homo sapiens; identical to SEQ ID NO: 8629

SEQ ID NO: 8641 - DNA, 201 bp, Homo sapiens
acgactgttcgagcgacatataaaacaaaataaacatttggaggaggaaaaaatgcgccacctgctgcatgtcctgaaagtagacttaggctgcacatcgraggaaaactcgttctccagtgtcaaaggcgacaataatcatgacatggagttatcaactcttaaaatcatggaaatgagcattgaggactgccctttgga

SEQ ID NO: 8642 - DNA, 201 bp, Homo sapiens; identical to SEQ ID NO: 8632

SEQ ID NO: 8643 - DNA, 129 bp, Homo sapiens; identical to SEQ ID NO: 8633

SEQ ID NO: 8644 - DNA, 201 bp, Homo sapiens; identical to SEQ ID NO: 8634

SEQ ID NO: 8645 - DNA, 201 bp, Homo sapiens; identical to SEQ ID NO: 8635

SEQ ID NO: 8646 - DNA, 201 bp, Homo sapiens; identical to SEQ ID NO: 8636

SEQ ID NO: 8647 - DNA, 201 bp, Homo sapiens; identical to SEQ ID NO: 8637

SEQ ID NO: 8648 - DNA, 201 bp, Homo sapiens; identical to SEQ ID NO: 8627

SEQ ID NO: 8649 - DNA, 124 bp, Homo sapiens
ccagcccttagcaacggcctggcracggtttccctgctgctgcagcccccgtcggctcctcttttccagtcctccactgccggggctgggcccggccgcgggaaggaccgaaggggatacagcg

SEQ ID NO: 8650 - DNA, 201 bp, Homo sapiens; identical to SEQ ID NO: 8628

SEQ ID NO: 8651 - DNA, 201 bp, Homo sapiens; identical to SEQ ID NO: 8629

SEQ ID NO: 8652 - DNA, 201 bp, Homo sapiens; identical to SEQ ID NO: 8630

SEQ ID NO: 8653 - DNA, 201 bp, Homo sapiens; identical to SEQ ID NO: 8631

SEQ ID NO: 8654 - DNA, 201 bp, Homo sapiens; identical to SEQ ID NO: 8632

SEQ ID NO: 8655 - DNA, 201 bp, Homo sapiens
ctcttttccagtcctccactgccggggctgggcccggccgcgggaaggaccgaaggggatacagcgtgtccctgcggcggctgcaagaggactaagcatgratggcagccggagagtcagagcaacctctgtccttcccagatatggtccaccgtgcctatttaaaggacacttgagcaccaaaagtaatgctttttgcac

SEQ ID NO: 8656 - DNA, 201 bp, Homo sapiens; identical to SEQ ID NO: 8635

SEQ ID NO: 8657 - DNA, 161 bp, Homo sapiens
ccagcccttagcaacggcctggcgacggtttccctgctgctgcagcccccgtcggctcctyttttccagtcctccactgccggggctgggcccggccgcgggaaggaccgaaggggatacagcgtgtccctgcggcggctgcaagaggactaagcatggat

SEQ ID NO: 8658 - DNA, 201 bp, Homo sapiens; identical to SEQ ID NO: 8636

SEQ ID NO: 8659 - DNA, 201 bp, Homo sapiens
tgctgctgcagcccccgtcggctcctcttttccagtcctccactgccggggctgggcccggccgcgggaaggaccgaaggggatacagcgtgtccctgcgrcggctgcaagaggactaagcatggatggcagccggagagtcagagcaacctctgtccttcccagatatggtccaccgtgcctatttaaaggacacttgag

SEQ ID NO: 8660 - DNA, 201 bp, Homo sapiens; identical to SEQ ID NO: 8627

SEQ ID NO: 8661 - DNA, 124 bp, Homo sapiens; identical to SEQ ID NO: 8649

SEQ ID NO: 8662 - DNA, 201 bp, Homo sapiens
agtaatgctgcagtagactgctcggttccagtaagcgtgagtaccagcataaagtatgcagaccaacaacgaagagagaaactcaaaaaggaattagcacratgtgaaaaagagttcaaattaactaaaactgcaatgcgagccaattataaaaataattccaagtcactttttaataccttacaaaagccctcaggcgaa

SEQ ID NO: 8663 - DNA, 201 bp, Homo sapiens; identical to SEQ ID NO: 8629

SEQ ID NO: 8664 - DNA, 201 bp, Homo sapiens; identical to SEQ ID NO: 8630

SEQ ID NO: 8665 - DNA, 201 bp, Homo sapiens; identical to SEQ ID NO: 8631

SEQ ID NO: 8666 - DNA, 201 bp, Homo sapiens; identical to SEQ ID NO: 8632

SEQ ID NO: 8667 - DNA, 201 bp, Homo sapiens
ctcttttccagtcctccactgccggggctgggcccggccgcgggaaggaccgaaggggatacagcgtgtccctgcggcggctgcaagaggactaagcatgratggcagccggagagtcagagcaacctctgtccttcccagatatggtccaccgtgcctatttaaaggacacttgagcaccaaaagtaatgctgcagtaga

SEQ ID NO: 8668 - DNA, 201 bp, Homo sapiens; identical to SEQ ID NO: 8635

SEQ ID NO: 8669 - DNA, 161 bp, Homo sapiens; identical to SEQ ID NO: 8657

SEQ ID NO: 8670 - DNA, 201 bp, Homo sapiens
agcaacctctgtccttcccagatatggtccaccgtgcctatttaaaggacacttgagcaccaaaagtaatgctgcagtagactgctcggttccagtaagcrtgagtaccagcataaagtatgcagaccaacaacgaagagagaaactcaaaaaggaattagcacaatgtgaaaaagagttcaaattaactaaaactgcaat

SEQ ID NO: 8671 - DNA, 201 bp, Homo sapiens; identical to SEQ ID NO: 8659

SEQ ID NO: 8672 - DNA, 201 bp, Homo sapiens; identical to SEQ ID NO: 8627

SEQ ID NO: 8673 - DNA, 124 bp, Homo sapiens; identical to SEQ ID NO: 8649

SEQ ID NO: 8674 - DNA, 201 bp, Homo sapiens; identical to SEQ ID NO: 8628

SEQ ID NO: 8675 - DNA, 201 bp, Homo sapiens; identical to SEQ ID NO: 8629

SEQ ID NO: 8676 - DNA, 201 bp, Homo sapiens; identical to SEQ ID NO: 8630

SEQ ID NO: 8677 - DNA, 201 bp, Homo sapiens; identical to SEQ ID NO: 8631

SEQ ID NO: 8678 - DNA, 201 bp, Homo sapiens; identical to SEQ ID NO: 8632

SEQ ID NO: 8679 - DNA, 201 bp, Homo sapiens; identical to SEQ ID NO: 8655

SEQ ID NO: 8680 - DNA, 201 bp, Homo sapiens
ccattcactcctcgcactttaaaaacagaagcaaaatctttcctgtcacagtatcgctattatacacctgccaaaagaaaaaaggattttacagatcaacrgatagaagctgaaacccagactgaattaagctttaaatctgagttggggacagctgagactaaaaacatgacagattcagaaatgaacataaagcaggta

SEQ ID NO: 8681 - DNA, 161 bp, Homo sapiens; identical to SEQ ID NO: 8657

SEQ ID NO: 8682 - DNA, 201 bp, Homo sapiens; identical to SEQ ID NO: 8636

SEQ ID NO: 8683 - DNA, 201 bp, Homo sapiens; identical to SEQ ID NO: 8659

SEQ ID NO: 8684 - DNA, 201 bp, Homo sapiens
cccaaccacaaagggacagtgtgaccctgagcaagtcactacctctgtccactttctgatctacaaaatgaaatgacggagatactgagtcagctgtggcrttctactcactaccaaatcataatttataaacctcgttaaccctccccaaaacacttgtattctttatgttaaaacaagtccgaagcttatatgagataa

SEQ ID NO: 8685 - DNA, 201 bp, Homo sapiens; identical to SEQ ID NO: 8627

SEQ ID NO: 8686 - DNA, 124 bp, Homo sapiens; identical to SEQ ID NO: 8649

SEQ ID NO: 8687 - DNA, 201 bp, Homo sapiens
acagaaccacaaccctaccctgcctttttctccacaggtcaggattccagatgattaacattaactgttcttcagaggctgagaaaatcacttaagagaartaagtacctacctcttctgctgtcaccattgctataattgcaattccctgttcccataccatctgccaaaaatcttgacaggtattctgtaatggtccct

SEQ ID NO: 8688 - DNA, 201 bp, Homo sapiens
aaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgt

SEQ ID NO: 8689 - DNA, 201 bp, Homo sapiens; identical to SEQ ID NO: 8629

SEQ ID NO: 8690 - DNA, 201 bp, Homo sapiens; identical to SEQ ID NO: 8662

SEQ ID NO: 8691 - DNA, 201 bp, Homo sapiens
acgactgttcgagcgacatataaaacaaaataaacatttggaggaggaaaaaatgcgccacctgctgcatgtcctgaaagtagacttaggctgcacatcgraggaaaactcggcaggcgatcatgatctccgacaaaatcaccacgccagtccttcctaccccagcactgcagtggaccaacaacggagggttggggcttt

SEQ ID NO: 8692 - DNA, 201 bp, Homo sapiens; identical to SEQ ID NO: 8632

SEQ ID NO: 8693 - DNA, 201 bp, Homo sapiens
tataaaacaaaataaacatttggaggaggaaaaaatgcgccacctgctgcatgtcctgaaagtagacttaggctgcacatcggaggaaaactcggcaggcratcatgatctccgacaaaatcaccacgccagtccttcctaccccagcactgcagtggaccaacaacggagggttggggctttggggatcacttgtgctat

SEQ ID NO: 8694 - DNA, 201 bp, Homo sapiens; identical to SEQ ID NO: 8667

SEQ ID NO: 8695 - DNA, 161 bp, Homo sapiens; identical to SEQ ID NO: 8657

SEQ ID NO: 8696 - DNA, 201 bp, Homo sapiens; identical to SEQ ID NO: 8635

SEQ ID NO: 8697 - DNA, 201 bp, Homo sapiens; identical to SEQ ID NO: 8659

SEQ ID NO: 8698 - DNA, 201 bp, Homo sapiens; identical to SEQ ID NO: 8670

SEQ ID NO: 8699 - DNA, 201 bp, Homo sapiens
tcggaggaaaactcggcaggcgatcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatca

SEQ ID NO: 8700 - DNA, 201 bp, Homo sapiens
cctctggttctgtgtgggggagtcatggccccaggaccagccgtggaccaagaggctcgtgatggtcaaggttgtgcccacgtgcctcagggccttggtaraaatggcccgggtagggggtgcctcctccctggagaatactgtggacctgcacatttccaacagccacccactctccctcacctccgaccagtacaaggc

SEQ ID NO: 8701 - DNA, 181 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgctatga

SEQ ID NO: 8702 - DNA, 201 bp, Homo sapiens
cgcagcctcgagtttgagagctacccggagctccaagacaggggtgggttccagctgcccgcacgccccgaccttccatcgtaggtaacgcggaagagccygggagagcgttggtggcgtccgagagcgaggagcgggaaagaggatgggtctgcacggagagtggaaaggcaggctgtgtactctggggaaagtggagca

SEQ ID NO: 8703 - DNA, 201 bp, Homo sapiens
gtcgatcaaaaagaaagccccagcgctctagagctcagctgacgggaaagggggtgcgcagcctcgagtttgagagctacccggagctccaagacaggggkgggttccagctgcccgcacgccccgaccttccatcgtaggtaacgcggaagagcccgggagagcgttggtggcgtccgagagcgaggagcgggaaagagg

SEQ ID NO: 8704 - DNA, 182 bp, Homo sapiens
cagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagctccaagacaggggtgggttcc

SEQ ID NO: 8705 - DNA, 201 bp, Homo sapiens
tttatttcaagaagtcgatcaaaaagaaagccccagcgctctagagctcagctgacgggaaagggggtgcgcagcctcgagtttgagagctacccggagcyccaagacaggggtgggttccagctgcccgcacgccccgaccttccatcgtaggtaacgcggaagagcccgggagagcgttggtggcgtccgagagcgagg

SEQ ID NO: 8706 - DNA, 201 bp, Homo sapiens
ctctcgggaggatgggaggatgggaagaggaggtttcctgtttgtacccccgaaaatatgggtgaaggacctgtgccgtggcccgtgagaaggaggtctgrgtgcggaaactccaggccaggtgggtccgggggaggccggtcgcgcccaggaaatgccctatacgcgcaggccggaccatgggaaccccaaagccacgga

SEQ ID NO: 8707 - DNA, 201 bp, Homo sapiens
gcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggagttggggacttttcccagccagacacctctccggacaccaatggtgga

SEQ ID NO: 8708 - DNA, 201 bp, Homo sapiens
gcaaggaccctcacgacccacataaaatctacgagtttgtgaactcaggagttggggacttttcccagccagacacctctccggacaccaatggtggaggyagtacttctgatacccaggaagacattctggatgagttactgggtaacatggtgttggccccactcccagatccgggacccccaagcctggctgtagccc

SEQ ID NO: 8709 - DNA, 201 bp, Homo sapiens; identical to SEQ ID NO: 8700

SEQ ID NO: 8710 - DNA, 177 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgct

SEQ ID NO: 8711 - DNA, 201 bp, Homo sapiens; identical to SEQ ID NO: 8702

SEQ ID NO: 8712 - DNA, 201 bp, Homo sapiens; identical to SEQ ID NO: 8703

SEQ ID NO: 8713 - DNA, 182 bp, Homo sapiens; identical to SEQ ID NO: 8704

SEQ ID NO: 8714 - DNA, 201 bp, Homo sapiens; identical to SEQ ID NO: 8705

SEQ ID NO: 8715 - DNA, 201 bp, Homo sapiens; identical to SEQ ID NO: 8706

SEQ ID NO: 8716 - DNA, 201 bp, Homo sapiens; identical to SEQ ID NO: 8707

SEQ ID NO: 8717 - DNA, 201 bp, Homo sapiens; identical to SEQ ID NO: 8708

SEQ ID NO: 8718 - DNA, 201 bp, Homo sapiens; identical to SEQ ID NO: 8700

SEQ ID NO: 8719 - DNA, 201 bp, Homo sapiens; identical to SEQ ID NO: 8707

SEQ ID NO: 8720 - DNA, 181 bp, Homo sapiens; identical to SEQ ID NO: 8701

SEQ ID NO: 8721 - DNA, 201 bp, Homo sapiens
gtcgatcaaaaagaaagccccagcgctctagagctcagctgacgggaaagggggtgcgcagcctcgagtttgagagctacccggagctccaagacaggggkgggttccagctgcccgcacgccccgaccttccatcgtaggccggaccatgggaaccccaaagccacggatcctgccctggctggtgtcgcagctggacct

SEQ ID NO: 8722 - DNA, 201 bp, Homo sapiens
aagggcataggggcgggaacagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagctccaagacaggggtgggttcc

SEQ ID NO: 8723 - DNA, 201 bp, Homo sapiens
tttatttcaagaagtcgatcaaaaagaaagccccagcgctctagagctcagctgacgggaaagggggtgcgcagcctcgagtttgagagctacccggagcyccaagacaggggtgggttccagctgcccgcacgccccgaccttccatcgtaggccggaccatgggaaccccaaagccacggatcctgccctggctggtgt

SEQ ID NO: 8724 - DNA, 201 bp, Homo sapiens; identical to SEQ ID NO: 8708

SEQ ID NO: 8725 - DNA, 201 bp, Homo sapiens
tttttgggtttccggccagaggcatgctgggagcgtcacatgcaaattgagcgtgcacccagcgttccgccctttctacgctgggccggttatcgacccgkcccagtgcgcaggcgcgggaaagttgaactaataaagtttgtacgagttcagtggaggagaccgcaagttgagtggaggaggcggcggtggggccccgga

SEQ ID NO: 8726 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctcctcagcgtggagcacgtgcacagcttcacgccctggatccag

SEQ ID NO: 8727 - DNA, 201 bp, Homo sapiens
tgctccactttccccagagtacacagcctgcctttccactctccgtgcagacccatcctctttcccgctcctcgctctcggacgccaccaacgctctcccrggctcttccgcgttacctacgatggaaggtcggggcgtgcgggcagctggaacccacccctgtcttggagctccgggtagctctcaaactcgaggctgcg

SEQ ID NO: 8728 - DNA, 201 bp, Homo sapiens
cctctttcccgctcctcgctctcggacgccaccaacgctctcccgggctcttccgcgttacctacgatggaaggtcggggcgtgcgggcagctggaacccmcccctgtcttggagctccgggtagctctcaaactcgaggctgcgcaccccctttcccgtcagctgagctctagagcgctggggctttctttttgatcgac

SEQ ID NO: 8729 - DNA, 201 bp, Homo sapiens
ggaacccacccctgtcttggagctccgggtagctctcaaactcgaggctgcgcaccccctttcccgtcagctgagctctagagcgctggggctttcttttygatcgacttcttgaaataaaaccaactttatcattctttgggtaacagacccaaaagccgatgggacggcccgctgggctgttcccgcccctatgccctt

SEQ ID NO: 8730 - DNA, 201 bp, Homo sapiens
cctcgctctcggacgccaccaacgctctcccgggctcttccgcgttacctacgatggaaggtcggggcgtgcgggcagctggaacccacccctgtcttggrgctccgggtagctctcaaactcgaggctgcgcaccccctttcccgtcagctgagctctagagcgctggggctttctttttgatcgacttcttgaaataaa

SEQ ID NO: 8731 - DNA, 201 bp, Homo sapiens; identical to SEQ ID NO: 8725

SEQ ID NO: 8732 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctccctgggcgtggagcacgtgcacagcttcacgccctggatcca

SEQ ID NO: 8733 - DNA, 201 bp, Homo sapiens; identical to SEQ ID NO: 8727

SEQ ID NO: 8734 - DNA, 201 bp, Homo sapiens; identical to SEQ ID NO: 8728

SEQ ID NO: 8735 - DNA, 201 bp, Homo sapiens; identical to SEQ ID NO: 8729

SEQ ID NO: 8736 - DNA, 201 bp, Homo sapiens; identical to SEQ ID NO: 8730

SEQ ID NO: 8737 - DNA, 102 bp, Homo sapiens
agtcttcctattccactcagggctgtggggtggtggttgccctacctgtttttgccaaaaataaattgtttaaaacttttcttattaaaaacgttacaaart

SEQ ID NO: 8738 - DNA, 201 bp, Homo sapiens; identical to SEQ ID NO: 8725

SEQ ID NO: 8739 - DNA, 201 bp, Homo sapiens; identical to SEQ ID NO: 8727

SEQ ID NO: 8740 - DNA, 201 bp, Homo sapiens
aagccatactgcggaggctggtggccctgctggaggaggaggcagaagtcattaaccagaagctggcctcggaccccgccctgcgcagcaagctggtccgmctgtcctccgactctttcgcccgcctggtggagctgttctgtagccgggatgacagctctcgcccaagccgagcatgccccgggcccccgcctccttccc

SEQ ID NO: 8741 - DNA, 201 bp, Homo sapiens; identical to SEQ ID NO: 8728

SEQ ID NO: 8742 - DNA, 201 bp, Homo sapiens; identical to SEQ ID NO: 8729

SEQ ID NO: 8743 - DNA, 201 bp, Homo sapiens; identical to SEQ ID NO: 8730

SEQ ID NO: 8744 - DNA, 102 bp, Homo sapiens; identical to SEQ ID NO: 8737

SEQ ID NO: 8745 - DNA, 201 bp, Homo sapiens; identical to SEQ ID NO: 8725

SEQ ID NO: 8746 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctccctggggcgaggagcagccccctctgagtcccctcggccttg

SEQ ID NO: 8747 - DNA, 201 bp, Homo sapiens; identical to SEQ ID NO: 8727

SEQ ID NO: 8748 - DNA, 201 bp, Homo sapiens; identical to SEQ ID NO: 8728

SEQ ID NO: 8749 - DNA, 201 bp, Homo sapiens; identical to SEQ ID NO: 8729

SEQ ID NO: 8750 - DNA, 201 bp, Homo sapiens; identical to SEQ ID NO: 8730

SEQ ID NO: 8751 - DNA, 201 bp, Homo sapiens; identical to SEQ ID NO: 8740

SEQ ID NO: 8752 - DNA, 102 bp, Homo sapiens; identical to SEQ ID NO: 8737

SEQ ID NO: 8753 - DNA, 201 bp, Homo sapiens
gagcatcagagtattatcactgctggaggaattttgtcaactacccacctggggatgaagctcactggccacaatacccacctctgtggatgatgttgtaygcactggagctgcactgcataattctaagtcttccaccctgtttaaagatttcaagaagatggcaaaatcatcttacatttttcagacttcatcttcaaa

SEQ ID NO: 8754 - DNA, 152 bp, Homo sapiens
tgattccgtgtgtgtactgattcaagaacaagcaatgatgacccactaaagagtgaatgccatttagaatctagaaatgttcacaaggtaccccaaaactstgtagcttaaaccaacaataaatatgtattacctctggcagtttctgtggg

SEQ ID NO: 8755 - DNA, 196 bp, Homo sapiens
gactccagaggaggaagtccagagacagagcaccatgacttctgagaaaggtccttcaaccggtgaccccactctgaggagaagaatcgaaccctrggagtttgacgtcttctatgaccccagagaacttcgtaaagaggcctgtctgctctacgaaatcaagtggggcatgagccggaagatctggcgaagctca

SEQ ID NO: 8756 - DNA, 201 bp, Homo sapiens
gccggaagatctggcgaagctcaggcaaaaacaccaccaatcacgtggaagttaattttataaaaaaatttacgtcagaaagagattttcacccatccatsagctgctccatcacctggttcttgtcctggagtccctgctgggaatgctcccaggctattagagagtttctgagtcggcaccctggtgtgactctagtga

SEQ ID NO: 8757 - DNA, 201 bp, Homo sapiens
cttacatttttcagacttcatcttcaaaactgccattaccaaacgattccgccacacatccttttagctacagggctgatacatccttctgtggcttggaratgaataggatgattccgtgtgtgtactgattcaagaacaagcaatgatgacccactaaagagtgaatgccatttagaatctagaaatgttcacaaggta

SEQ ID NO: 8758 - DNA, 201 bp, Homo sapiens; identical to SEQ ID NO: 8753

SEQ ID NO: 8759 - DNA, 152 bp, Homo sapiens; identical to SEQ ID NO: 8754

SEQ ID NO: 8760 - DNA, 168 bp, Homo sapiens
gactccagaggaggaagtccagagacagagcaccatgacttctgagaaaggagaagaatcgaaccctrggagtttgacgtcttctatgaccccagagaacttcgtaaagaggcctgtctgctctacgaaatcaagtggggcatgagccggaagatctggcgaagctca

SEQ ID NO: 8761 - DNA, 201 bp, Homo sapiens; identical to SEQ ID NO: 8756

SEQ ID NO: 8762 - DNA, 201 bp, Homo sapiens; identical to SEQ ID NO: 8757

SEQ ID NO: 8763 - DNA, 201 bp, Homo sapiens
gcctgactgggaaattaaagaaggctgatgctgtacgtgtgattacattcactggctgcatgggagaaacatactttgacaacaaacctataggtttgtgraatttccgagaaaaagaaggtgactgcaaaggatgcactgtcagtcctcaggtggaagatagtgaggggactattcaatttgatggagaaggttatgcat

SEQ ID NO: 8764 - DNA, 201 bp, Homo sapiens
atgtgaccgctgtgcccacggctatttcaacttccaagaaggaggctgcacagcttgtgaatgttctcatctgggtaataattgtgacccaaagactgggygatgcatttgccctcccaataccattggagagaaatgttctaaatgtgcacccaatacctggggccacagcattaccactggttgtaaggcttgtaactg

SEQ ID NO: 8765 - DNA, 201 bp, Homo sapiens
aaggctgggacctttggcctacaatcagcaaggggctgtgttccctgcaactgcaattcttttgggtctaagtcattcgactgtgaagagagtggacaatrttggtgccaacctggagtcacagggaagaaatgtgaccgctgtgcccacggctatttcaacttccaagaaggaggctgcacagcttgtgaatgttctcat

SEQ ID NO: 8766 - DNA, 201 bp, Homo sapiens
ttcagcaccaagaatgagtccggcatcattcttttgggaagtggagggacaccagcaccacctaggagaaaacgaaggcagactggacaggcctattatgyaatactcctcaacaggggccgtctggaagtgcatctctccacaggggcacgaacaatgaggaaaattgtgatcagaccagagccaaatctgtttcatgat

SEQ ID NO: 8767 - DNA, 201 bp, Homo sapiens
tcactgctgtctatgatgctggggttccagggcatttgtgtgatggacaatggcataaagtcactgccaacaagatcaaacaccgcattgagctcacagtygatgggaaccaggtggaagcccaaagcccaaacccagcatctacatcagctgacacaaatgaccctgtgtttgttggaggcttcccagatgacctcaagc

SEQ ID NO: 8768 - DNA, 201 bp, Homo sapiens
aaagttgatgtttcatgtggacaatggtgcgggcagattcactgctgtctatgatgctggggttccagggcatttgtgtgatggacaatggcataaagtcrctgccaacaagatcaaacaccgcattgagctcacagtcgatgggaaccaggtggaagcccaaagcccaaacccagcatctacatcagctgacacaaatga

SEQ ID NO: 8769 - DNA, 201 bp, Homo sapiens
caacgactggagttcttctggggatcagtagtcaaaaaatggatggaatgggtattgaaatgattgatgaaaagttgatgtttcatgtggacaatggtgcrggcagattcactgctgtctatgatgctggggttccagggcatttgtgtgatggacaatggcataaagtcactgccaacaagatcaaacaccgcattgagc

SEQ ID NO: 8770 - DNA, 201 bp, Homo sapiens
aacgaaggcagactggacaggcctattatgcaatactcctcaacaggggccgtctggaagtgcatctctccacaggggcacgaacaatgaggaaaattgtsatcagaccagagccaaatctgtttcatgatggaagagaacattccgttcatgtagagcgaactagaggcatctttacagttcaagtggatgaaaacagaa

SEQ ID NO: 8771 - DNA, 151 bp, Homo sapiens
cagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacat

SEQ ID NO: 8772 - DNA, 122 bp, Homo sapiens
atttgtgcatgtacatagaattctttctgtattcagatggtgctaattcagactccagactgaattttaattcaagttctttctcaagtctataaataatattaaactgattatttcattct

SEQ ID NO: 8773 - DNA, 123 bp, Homo sapiens
aatttgtgcatgtacatagaattctttctgtattcagatggtgctaattcagactccagactgaattttaattcaagttctttctcaagtctataaataatattaaactgattatttcattct

SEQ ID NO: 8774 - DNA, 201 bp, Homo sapiens
gacaggcctattatgcaatactcctcaacaggggccgtctggaagtgcatctctccacaggggcacgaacaatgaggaaaattgtgatcagaccagagccraatctgtttcatgatggaagagaacattccgttcatgtagagcgaactagaggcatctttacagttcaagtggatgaaaacagaagatacatgcaaaacc

SEQ ID NO: 8775 - DNA, 124 bp, Homo sapiens
taatttgtgcatgtacatagaattctttctgtattcagatggtgctaattcagactccagactgaattttaattcaagttctttctcaagtctataaataatattaaactgattatttcattct

SEQ ID NO: 8776 - DNA, 201 bp, Homo sapiens
gaaatgacagagaaagaatggaaatattatggggatgatcctcgagtccatagaactgtgacccgagaagacttcttggatatactatatgatattcattrcattcttatcaaagctacttatggaaatttcatgcgacaaagcaggatttctgaaatctcaatggaggtagctgaacaaggacgtggaacaacaatgact

SEQ ID NO: 8777 - DNA, 201 bp, Homo sapiens
ggatccttggatttccaatgcaatgtaaatacaggccaatgcaactgtcatccaaaattctctggtgcaaaatgtacagagtgcagtcgaggtcactggarctaccctcgctgcaatctctgtgactgcttcctccctgggacagatgccacaacctgtgattcagagactaaaaaatgctcctgtagtgatcaaactggg

SEQ ID NO: 8778 - DNA, 199 bp, Homo sapiens
ccaggaagagtctgtcaaaacaagtatatcaagtaaaacaaacaaatatattttacctatatatgttaattaaactaatttgtgcatgtacatagaattcyttctgtattcagatggtgctaattcagactccagactgaattttaattcaagttctttctcaagtctataaataatattaaactgattatttcattct

SEQ ID NO: 8779 - DNA, 201 bp, Homo sapiens
tgaagaagaggaagaagatacagaacgtgttctccagcttatgattatcttagagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagt

SEQ ID NO: 8780 - DNA, 201 bp, Homo sapiens
gaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtccccatggactttgcaaggcctgtgtccttcaaaaatgctgacattggtcgct

SEQ ID NO: 8781 - DNA, 201 bp, Homo sapiens
ctggacagtgtgagtgcagagccaacgttcagggtcagagatgtgacaaatgcaaggctgggacctttggcctacaatcagcaaggggctgtgttccctgmaactgcaattcttttgggtctaagtcattcgactgtgaagagagtggacaatgttggtgccaacctggagtcacagggaagaaatgtgaccgctgtgccc

SEQ ID NO: 8782 - DNA, 201 bp, Homo sapiens
gaattgtcaagggattgccaaatgactgtcagcaatgtgcctgccctctgatttcttccagtaacaatttcagcccctcttgtgtcgcagaaggacttgaygactaccgctgcacggcttgtccacggggatatgaaggccagtactgtgaaaggtgtgcccctggctatactggcagtccaggcaaccctggaggctcct

SEQ ID NO: 8783 - DNA, 201 bp, Homo sapiens
atcaggaggagaatatagcaacttcgtcttctggaaacaactttggtcttgacttgaaagcagatgacaaaatatattttggtggcctgccaacgctgagwaacttgagtattcaataggccagaagtaaatctgaagaaatattccggctgcctcaaagatattgaaatttcaagaactccgtacaatatactcagtagt

SEQ ID NO: 8784 - DNA, 201 bp, Homo sapiens
cggactgcaaagcctgtaactgcagtgggttagggagcaaaaatgaggatccttgttttggcccctgtatctgcaaggaaaatgttgaaggaggagactgyagtcgttgcaaatccggcttcttcaatttgcaagaggataattggaaaggctgcgatgagtgtttctgttcaggggtttcaaacagatgtcagagttcct

SEQ ID NO: 8785 - DNA, 201 bp, Homo sapiens
gcgtacaggcgcagcggccgcagcagcagcggcagtcacaggcacatcagcaaagaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatct

SEQ ID NO: 8786 - DNA, 201 bp, Homo sapiens
cacaagagcaaagtccctgggagaattcattaaggagcttgcccgggatgcagaagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaat

SEQ ID NO: 8787 - DNA, 201 bp, Homo sapiens
gcaaaggatgcactgtcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacacgagacctgagagatttcatgagtgtgg

SEQ ID NO: 8788 - DNA, 201 bp, Homo sapiens
ggcacgaacaatgaggaaaattgtgatcagaccagagccaaatctgtttcatgatggaagagaacattccgttcatgtagagcgaactagaggcatctttrcagttcaagtggatgaaaacagaagatacatgcaaaacctgacagttgaacagcctatcgaagttaaaaagcttttcgttgggggtgctccacctgaatt

SEQ ID NO: 8789 - DNA, 201 bp, Homo sapiens
tctgtgctgatggatattttggagatgcagttgatgcgaagaactgtcagccctgtcgctgtaatgccggtggctctttctctgaggtttgccacagtcaractggacagtgtgagtgcagagccaacgttcagggtcagagatgtgacaaatgcaaggctgggacctttggcctacaatcagcaaggggctgtgttccct

SEQ ID NO: 8790 - DNA, 201 bp, Homo sapiens
tgatgaggctaaaaacatctccttcaatgccactgcagccttcaaagcttacagcaatattaaggactatattgatgaagctgagaaagttgccaaagaarccaaagatcttgcacatgaagctacaaaactggcaacaggtcctcggggtttattaaaggaagatgccaaaggctgtcttcagaaaagcttcaggattct

SEQ ID NO: 8791 - DNA, 201 bp, Homo sapiens
ggctcctgtctgatatgtaaaccaggtacaacaggccggtactgtgagctctgtgctgatggatattttggagatgcagttgatgcgaagaactgtcagcrctgtcgctgtaatgccggtggctctttctctgaggtttgccacagtcaaactggacagtgtgagtgcagagccaacgttcagggtcagagatgtgacaaa

SEQ ID NO: 8792 - DNA, 201 bp, Homo sapiens
tgttccagatcgcgtatgtgattgtgaaggcagctaactccccccggcctggaaactggattttggaacgctctcttgatgatgttgaatacaagccctgrcagtatcatgctgtgacagacacggagtgcctaacgctttacaatatttatccccgcactgggccaccgtcatatgccaaagatgatgaggtcatctgca

SEQ ID NO: 8793 - DNA, 201 bp, Homo sapiens
tgctcctctgattggccaattgacaaggcatgaaattgaaatgacagagaaagaatggaaatattatggggatgatcctcgagtccatagaactgtgaccygagaagacttcttggatatactatatgatattcattacattcttatcaaagctacttatggaaatttcatgcgacaaagcaggatttctgaaatctcaat

SEQ ID NO: 8794 - DNA, 201 bp, Homo sapiens
ttttgagagaagccacagataaaatcagagaagctaatcgcctatttgcagtaaatcagaaaaacatgactgcattggagaaaaagaaggaggctgttgaragcggcaaacgacaaattgagaacactttaaaagagggcaatgacatactcgatgaagccaaccgtcttgcagatgaaatcaactccatcatagactatg

SEQ ID NO: 8795 - DNA, 201 bp, Homo sapiens
tggattgatctgtgatggatgccctgtcgggtacacaggaccacgctgtgagaggtgtgcagaaggctattttggacaaccctctgtacctggaggatcaygtcagccatgccaatgcaatgacaaccttgacttctccatccctggcagctgtgacagcttgtctggctcctgtctgatatgtaaaccaggtacaacagg

SEQ ID NO: 8796 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacattgccgatgcagatgccactgtcaaaaatttagaacaggaagctgaccggctaatagataaactcaaac

SEQ ID NO: 8797 - DNA, 201 bp, Homo sapiens
cagtccaggcaaccctggaggctcctgccaagaatgtgagtgtgatccctatggctcactgcctgtgccctgtgaccctgtcacaggattctgcacgtgcygacctggagccacgggaaggaagtgtgacggctgcaagcactggcatgcacgcgagggctgggagtgtgttttttgtggagatgagtgcactggccttct

SEQ ID NO: 8798 - DNA, 201 bp, Homo sapiens
gatcagcatcagtaacgcggaggcccggcaagccctgccgcacagctactactggagcgcgccggctccctatctgggaaacaaactcccagcagtaggargacagttgacatttaccatatcatatgaccttgaagaagaggaagaagatacagaacgtgttctccagcttatgattatcttagagggtaatgacttgag

SEQ ID NO: 8799 - DNA, 201 bp, Homo sapiens
accagagacacccgattacaaatgctattgatggaaagaacacttggtggcagagtcccagtattaagaatggaatcgaataccattatgtgacaattacmctggatttacagcaggtgttccagatcgcgtatgtgattgtgaaggcagctaactccccccggcctggaaactggattttggaacgctctcttgatgatg

SEQ ID NO: 8800 - DNA, 201 bp, Homo sapiens
agtgtttctgttcaggggtttcaaacagatgtcagagttcctactggacctatggcaaaatacaagatatgagtggctggtatctgactgaccttcctggycgcattcgagtggctccccagcaggacgacttggactcacctcagcagatcagcatcagtaacgcggaggcccggcaagccctgccgcacagctactact

SEQ ID NO: 8801 - DNA, 201 bp, Homo sapiens
gacctttggcctacaatcagcaaggggctgtgttccctgcaactgcaattcttttgggtctaagtcattcgactgtgaagagagtggacaatgttggtgcyaacctggagtcacagggaagaaatgtgaccgctgtgcccacggctatttcaacttccaagaaggaggctgcacagcttgtgaatgttctcatctgggtaa

SEQ ID NO: 8802 - DNA, 201 bp, Homo sapiens
attggtcagccgtcccattcgctggtaccccaacatctccactgtcatgttcaagttcagaacattttcttcgagtgctcttctgatgtatcttgccacaygagacctgagagatttcatgagtgtggagctcactgatgggcacataaaagtcagttacgatctgggctcaggaatggcttccgttgtcagcaatcaaaa

SEQ ID NO: 8803 - DNA, 201 bp, Homo sapiens
tgagtgtgatccctatggctcactgcctgtgccctgtgaccctgtcacaggattctgcacgtgccgacctggagccacgggaaggaagtgtgacggctgcmagcactggcatgcacgcgagggctgggagtgtgttttttgtggagatgagtgcactggccttcttctcggtgacttggctcgcctggagcagatggtcat

SEQ ID NO: 8804 - DNA, 201 bp, Homo sapiens
tggctgcagcagctgctattgcttcggcactactacccagtgctctgaagcaaaaggactgatccggacgtgggtgactctgaaggctgagcagaccattytacccctggtagatgaggctctgcagcacacgaccaccaagggcattgtttttcaacatccagagattgttgcccacatggacctgatgagagaagatct

SEQ ID NO: 8805 - DNA, 201 bp, Homo sapiens
ctgaaatgtactgcaaattggtagaacatgtccctgggcagcctgtgaggaacccgcagtgtcgaatctgcaatcaaaacagcagcaatccaaaccagagmcacccgattacaaatgctattgatggaaagaacacttggtggcagagtcccagtattaagaatggaatcgaataccattatgtgacaattacactggatt

SEQ ID NO: 8806 - DNA, 201 bp, Homo sapiens
tggaactgaggggcgttcaacctgtatcatgcccagccaactaataaaaataagtgtaaccccaggaagagtctgtcaaaacaagtatatcaagtaaaacmaacaaatatattttacctatatatgttaattaaactaatttgtgcatgtacatagaattctttctgtattcagatggtgctaattcagactccagactga

SEQ ID NO: 8807 - DNA, 201 bp, Homo sapiens
atcgcctatttgcagtaaatcagaaaaacatgactgcattggagaaaaagaaggaggctgttgaaagcggcaaacgacaaattgagaacactttaaaagarggcaatgacatactcgatgaagccaaccgtcttgcagatgaaatcaactccatcatagactatgttgaagacatccaaactaaattgccacctatgtctg

SEQ ID NO: 8808 - DNA, 201 bp, Homo sapiens
gggctgtgttccctgcaactgcaattcttttgggtctaagtcattcgactgtgaagagagtggacaatgttggtgccaacctggagtcacagggaagaaaygtgaccgctgtgcccacggctatttcaacttccaagaaggaggctgcacagcttgtgaatgttctcatctgggtaataattgtgacccaaagactgggcg

SEQ ID NO: 8809 - DNA, 201 bp, Homo sapiens
atactggcagtccaggcaaccctggaggctcctgccaagaatgtgagtgtgatccctatggctcactgcctgtgccctgtgaccctgtcacaggattctgmacgtgccgacctggagccacgggaaggaagtgtgacggctgcaagcactggcatgcacgcgagggctgggagtgtgttttttgtggagatgagtgcactg

SEQ ID NO: 8810 - DNA, 201 bp, Homo sapiens
acaccccttagaaaatggagagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaag

SEQ ID NO: 8811 - DNA, 201 bp, Homo sapiens
ttgaaaatatgactcaggagctaaagcacttgctgtcacctcagcgggccccagagaggcttattcagctggcagagggcaatctgaatacactcgtgacmgaaatgaacgagctgctgaccagggctaccaaagtgacagcagatggcgagcagaccggacaggatgctgagaggaccaacacaagagcaaagtccctgg

SEQ ID NO: 8812 - DNA, 201 bp, Homo sapiens
tctctgtgactgcttcctccctgggacagatgccacaacctgtgattcagagactaaaaaatgctcctgtagtgatcaaactgggcagtgcacttgtaagrtgaatgtggaaggcatccactgtgacagatgccggcctggcaaattcggactcgatgccaagaatccacttggctgcagcagctgctattgcttcggcac

SEQ ID NO: 8813 - DNA, 201 bp, Homo sapiens
gaaatattcctccttttgaaggctgcatatggaatcttgttattaactctgtccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgc

SEQ ID NO: 8814 - DNA, 201 bp, Homo sapiens
tgtctgatatgtaaaccaggtacaacaggccggtactgtgagctctgtgctgatggatattttggagatgcagttgatgcgaagaactgtcagccctgtckctgtaatgccggtggctctttctctgaggtttgccacagtcaaactggacagtgtgagtgcagagccaacgttcagggtcagagatgtgacaaatgcaag

SEQ ID NO: 8815 - DNA, 201 bp, Homo sapiens
taaagcacttgctgtcacctcagcgggccccagagaggcttattcagctggcagagggcaatctgaatacactcgtgaccgaaatgaacgagctgctgacsagggctaccaaagtgacagcagatggcgagcagaccggacaggatgctgagaggaccaacacaagagcaaagtccctgggagaattcattaaggagcttg

SEQ ID NO: 8816 - DNA, 201 bp, Homo sapiens
aactttagcccaacgtgccatttagaccggagtcttggattgatctgtgatggatgccctgtcgggtacacaggaccacgctgtgagaggtgtgcagaagrctattttggacaaccctctgtacctggaggatcatgtcagccatgccaatgcaatgacaaccttgacttctccatccctggcagctgtgacagcttgtct

SEQ ID NO: 8817 - DNA, 201 bp, Homo sapiens
tactacccagtgctctgaagcaaaaggactgatccggacgtgggtgactctgaaggctgagcagaccattctacccctggtagatgaggctctgcagcacrcgaccaccaagggcattgtttttcaacatccagagattgttgcccacatggacctgatgagagaagatctccatttggaacctttttattggaaacttcc

SEQ ID NO: 8818 - DNA, 201 bp, Homo sapiens
gcgccggctccctatctgggaaacaaactcccagcagtaggaggacagttgacatttaccatatcatatgaccttgaagaagaggaagaagatacagaacrtgttctccagcttatgattatcttagagggtaatgacttgagcatcagcacagcccaagatgaggtgtacctgcacccatctgaagaacatactaatgta

SEQ ID NO: 8819 - DNA, 201 bp, Homo sapiens
atgaggatccttgttttggcccctgtatctgcaaggaaaatgttgaaggaggagactgtagtcgttgcaaatccggcttcttcaatttgcaagaggataaytggaaaggctgcgatgagtgtttctgttcaggggtttcaaacagatgtcagagttcctactggacctatggcaaaatacaagatatgagtggctggtatc

SEQ ID NO: 8820 - DNA, 201 bp, Homo sapiens
aaacccagcatctacatcagctgacacaaatgaccctgtgtttgttggaggcttcccagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatc

SEQ ID NO: 8821 - DNA, 201 bp, Homo sapiens
caccaagggcattgtttttcaacatccagagattgttgcccacatggacctgatgagagaagatctccatttggaacctttttattggaaacttccagaayaatttgaaggaaagaagttgatggcctatgggggcaaactcaagtatgcaatctatttcgaggctcgggaagaaacaggtttctctacatataatcctca

SEQ ID NO: 8822 - DNA, 201 bp, Homo sapiens
ctgtgacagatgccggcctggcaaattcggactcgatgccaagaatccacttggctgcagcagctgctattgcttcggcactactacccagtgctctgaarcaaaaggactgatccggacgtgggtgactctgaaggctgagcagaccattctacccctggtagatgaggctctgcagcacacgaccaccaagggcattgt

SEQ ID NO: 8823 - DNA, 201 bp, Homo sapiens
tttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggcctattatgcaatactcctcaacaggggccgtctggaagtg

SEQ ID NO: 8824 - DNA, 201 bp, Homo sapiens; identical to SEQ ID NO: 8763

SEQ ID NO: 8825 - DNA, 201 bp, Homo sapiens; identical to SEQ ID NO: 8764

SEQ ID NO: 8826 - DNA, 201 bp, Homo sapiens; identical to SEQ ID NO: 8765

SEQ ID NO: 8827 - DNA, 201 bp, Homo sapiens; identical to SEQ ID NO: 8767

SEQ ID NO: 8828 - DNA, 201 bp, Homo sapiens; identical to SEQ ID NO: 8766

SEQ ID NO: 8829 - DNA, 201 bp, Homo sapiens; identical to SEQ ID NO: 8768

SEQ ID NO: 8830 - DNA, 201 bp, Homo sapiens; identical to SEQ ID NO: 8769

SEQ ID NO: 8831 - DNA, 201 bp, Homo sapiens; identical to SEQ ID NO: 8770

SEQ ID NO: 8832 - DNA, 151 bp, Homo sapiens; identical to SEQ ID NO: 8771

SEQ ID NO: 8833 - DNA, 122 bp, Homo sapiens; identical to SEQ ID NO: 8772

SEQ ID NO: 8834 - DNA, 123 bp, Homo sapiens; identical to SEQ ID NO: 8773

SEQ ID NO: 8835 - DNA, 201 bp, Homo sapiens; identical to SEQ ID NO: 8774

SEQ ID NO: 8836 - DNA, 124 bp, Homo sapiens; identical to SEQ ID NO: 8775

SEQ ID NO: 8837 - DNA, 201 bp, Homo sapiens; identical to SEQ ID NO: 8776

SEQ ID NO: 8838 - DNA, 201 bp, Homo sapiens; identical to SEQ ID NO: 8777

SEQ ID NO: 8839 - DNA, 199 bp, Homo sapiens; identical to SEQ ID NO: 8778

SEQ ID NO: 8840 - DNA, 201 bp, Homo sapiens; identical to SEQ ID NO: 8780

SEQ ID NO: 8841 - DNA, 201 bp, Homo sapiens; identical to SEQ ID NO: 8779

SEQ ID NO: 8842 - DNA, 201 bp, Homo sapiens; identical to SEQ ID NO: 8781

SEQ ID NO: 8843 - DNA, 201 bp, Homo sapiens; identical to SEQ ID NO: 8782

SEQ ID NO: 8844 - DNA, 201 bp, Homo sapiens
atcaggaggagaatatagcaacttcgtcttctggaaacaactttggtcttgacttgaaagcagatgacaaaatatattttggtggcctgccaacgctgagwaacttgaggccagaagtaaatctgaagaaatattccggctgcctcaaagatattgaaatttcaagaactccgtacaatatactcagtagtcccgattatg

SEQ ID NO: 8845 - DNA, 201 bp, Homo sapiens; identical to SEQ ID NO: 8784

SEQ ID NO: 8846 - DNA, 201 bp, Homo sapiens; identical to SEQ ID NO: 8785

SEQ ID NO: 8847 - DNA, 201 bp, Homo sapiens; identical to SEQ ID NO: 8786

SEQ ID NO: 8848 - DNA, 201 bp, Homo sapiens; identical to SEQ ID NO: 8788

SEQ ID NO: 8849 - DNA, 201 bp, Homo sapiens; identical to SEQ ID NO: 8787

SEQ ID NO: 8850 - DNA, 201 bp, Homo sapiens; identical to SEQ ID NO: 8789

SEQ ID NO: 8851 - DNA, 201 bp, Homo sapiens; identical to SEQ ID NO: 8790

SEQ ID NO: 8852 - DNA, 201 bp, Homo sapiens; identical to SEQ ID NO: 8791

SEQ ID NO: 8853 - DNA, 201 bp, Homo sapiens; identical to SEQ ID NO: 8792

SEQ ID NO: 8854 - DNA, 201 bp, Homo sapiens; identical to SEQ ID NO: 8793

SEQ ID NO: 8855 - DNA, 201 bp, Homo sapiens; identical to SEQ ID NO: 8794

SEQ ID NO: 8856 - DNA, 201 bp, Homo sapiens; identical to SEQ ID NO: 8795

SEQ ID NO: 8857 - DNA, 201 bp, Homo sapiens; identical to SEQ ID NO: 8796

SEQ ID NO: 8858 - DNA, 201 bp, Homo sapiens; identical to SEQ ID NO: 8797

SEQ ID NO: 8859 - DNA, 201 bp, Homo sapiens; identical to SEQ ID NO: 8798

SEQ ID NO: 8860 - DNA, 201 bp, Homo sapiens; identical to SEQ ID NO: 8799

SEQ ID NO: 8861 - DNA, 201 bp, Homo sapiens; identical to SEQ ID NO: 8800

SEQ ID NO: 8862 - DNA, 201 bp, Homo sapiens; identical to SEQ ID NO: 8801

SEQ ID NO: 8863 - DNA, 201 bp, Homo sapiens; identical to SEQ ID NO: 8802

SEQ ID NO: 8864 - DNA, 201 bp, Homo sapiens; identical to SEQ ID NO: 8803

SEQ ID NO: 8865 - DNA, 201 bp, Homo sapiens; identical to SEQ ID NO: 8804

SEQ ID NO: 8866 - DNA, 201 bp, Homo sapiens; identical to SEQ ID NO: 8805

SEQ ID NO: 8867 - DNA, 201 bp, Homo sapiens; identical to SEQ ID NO: 8806

SEQ ID NO: 8868 - DNA, 201 bp, Homo sapiens; identical to SEQ ID NO: 8807

SEQ ID NO: 8869 - DNA, 201 bp, Homo sapiens; identical to SEQ ID NO: 8808

SEQ ID NO: 8870 - DNA, 201 bp, Homo sapiens; identical to SEQ ID NO: 8809

SEQ ID NO: 8871 - DNA, 201 bp, Homo sapiens; identical to SEQ ID NO: 8810

SEQ ID NO: 8872 - DNA, 201 bp, Homo sapiens; identical to SEQ ID NO: 8811

SEQ ID NO: 8873 - DNA, 201 bp, Homo sapiens; identical to SEQ ID NO: 8812

SEQ ID NO: 8874 - DNA, 201 bp, Homo sapiens; identical to SEQ ID NO: 8813

SEQ ID NO: 8875 - DNA, 201 bp, Homo sapiens; identical to SEQ ID NO: 8814

SEQ ID NO: 8876 - DNA, 201 bp, Homo sapiens; identical to SEQ ID NO: 8815

SEQ ID NO: 8877 - DNA, 201 bp, Homo sapiens; identical to SEQ ID NO: 8816

SEQ ID NO: 8878 - DNA, 201 bp, Homo sapiens; identical to SEQ ID NO: 8817

SEQ ID NO: 8879 - DNA, 201 bp, Homo sapiens; identical to SEQ ID NO: 8818

SEQ ID NO: 8880 - DNA, 201 bp, Homo sapiens; identical to SEQ ID NO: 8819

SEQ ID NO: 8881 - DNA, 201 bp, Homo sapiens; identical to SEQ ID NO: 8820

SEQ ID NO: 8882 - DNA, 201 bp, Homo sapiens; identical to SEQ ID NO: 8821

SEQ ID NO: 8883 - DNA, 201 bp, Homo sapiens; identical to SEQ ID NO: 8822

SEQ ID NO: 8884 - DNA, 201 bp, Homo sapiens; identical to SEQ ID NO: 8823

SEQ ID NO: 8885 - DNA, 201 bp, Homo sapiens; identical to SEQ ID NO: 8763

SEQ ID NO: 8886 - DNA, 201 bp, Homo sapiens; identical to SEQ ID NO: 8764

SEQ ID NO: 8887 - DNA, 201 bp, Homo sapiens; identical to SEQ ID NO: 8765

SEQ ID NO: 8888 - DNA, 201 bp, Homo sapiens; identical to SEQ ID NO: 8766

SEQ ID NO: 8889 - DNA, 201 bp, Homo sapiens; identical to SEQ ID NO: 8767

SEQ ID NO: 8890 - DNA, 201 bp, Homo sapiens; identical to SEQ ID NO: 8768

SEQ ID NO: 8891 - DNA, 201 bp, Homo sapiens; identical to SEQ ID NO: 8769

SEQ ID NO: 8892 - DNA, 201 bp, Homo sapiens; identical to SEQ ID NO: 8770

SEQ ID NO: 8893 - DNA, 151 bp, Homo sapiens; identical to SEQ ID NO: 8771

SEQ ID NO: 8894 - DNA, 122 bp, Homo sapiens; identical to SEQ ID NO: 8772

SEQ ID NO: 8895 - DNA, 123 bp, Homo sapiens; identical to SEQ ID NO: 8773

SEQ ID NO: 8896 - DNA, 201 bp, Homo sapiens; identical to SEQ ID NO: 8774

SEQ ID NO: 8897 - DNA, 124 bp, Homo sapiens; identical to SEQ ID NO: 8775

SEQ ID NO: 8898 - DNA, 201 bp, Homo sapiens; identical to SEQ ID NO: 8776

SEQ ID NO: 8899 - DNA, 201 bp, Homo sapiens; identical to SEQ ID NO: 8777

SEQ ID NO: 8900 - DNA, 199 bp, Homo sapiens; identical to SEQ ID NO: 8778

SEQ ID NO: 8901 - DNA, 201 bp, Homo sapiens; identical to SEQ ID NO: 8779

SEQ ID NO: 8902 - DNA, 201 bp, Homo sapiens; identical to SEQ ID NO: 8780

SEQ ID NO: 8903 - DNA, 201 bp, Homo sapiens; identical to SEQ ID NO: 8781

SEQ ID NO: 8904 - DNA, 201 bp, Homo sapiens; identical to SEQ ID NO: 8782

SEQ ID NO: 8905 - DNA, 201 bp, Homo sapiens; identical to SEQ ID NO: 8783

SEQ ID NO: 8906 - DNA, 201 bp, Homo sapiens; identical to SEQ ID NO: 8784

SEQ ID NO: 8907 - DNA, 201 bp, Homo sapiens; identical to SEQ ID NO: 8785

SEQ ID NO: 8908 - DNA, 201 bp, Homo sapiens; identical to SEQ ID NO: 8786

SEQ ID NO: 8909 - DNA, 201 bp, Homo sapiens; identical to SEQ ID NO: 8788

SEQ ID NO: 8910 - DNA, 201 bp, Homo sapiens; identical to SEQ ID NO: 8787

SEQ ID NO: 8911 - DNA, 201 bp, Homo sapiens; identical to SEQ ID NO: 8789

SEQ ID NO: 8912 - DNA, 201 bp, Homo sapiens; identical to SEQ ID NO: 8790

SEQ ID NO: 8913 - DNA, 201 bp, Homo sapiens; identical to SEQ ID NO: 8791

SEQ ID NO: 8914 - DNA, 201 bp, Homo sapiens; identical to SEQ ID NO: 8792

SEQ ID NO: 8915 - DNA, 201 bp, Homo sapiens; identical to SEQ ID NO: 8793

SEQ ID NO: 8916 - DNA, 201 bp, Homo sapiens; identical to SEQ ID NO: 8794

SEQ ID NO: 8917 - DNA, 201 bp, Homo sapiens; identical to SEQ ID NO: 8795

SEQ ID NO: 8918 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacattctatgcagttgccgatgcagatgccactgtcaaaaatttagaacaggaagctgaccggctaatagat

SEQ ID NO: 8919 - DNA, 201 bp, Homo sapiens; identical to SEQ ID NO: 8797

SEQ ID NO: 8920 - DNA, 201 bp, Homo sapiens; identical to SEQ ID NO: 8798

SEQ ID NO: 8921 - DNA, 201 bp, Homo sapiens; identical to SEQ ID NO: 8799

SEQ ID NO: 8922 - DNA, 201 bp, Homo sapiens; identical to SEQ ID NO: 8800

SEQ ID NO: 8923 - DNA, 201 bp, Homo sapiens; identical to SEQ ID NO: 8801

SEQ ID NO: 8924 - DNA, 201 bp, Homo sapiens; identical to SEQ ID NO: 8802

SEQ ID NO: 8925 - DNA, 201 bp, Homo sapiens; identical to SEQ ID NO: 8803

SEQ ID NO: 8926 - DNA, 201 bp, Homo sapiens; identical to SEQ ID NO: 8804

SEQ ID NO: 8927 - DNA, 201 bp, Homo sapiens; identical to SEQ ID NO: 8805

SEQ ID NO: 8928 - DNA, 201 bp, Homo sapiens; identical to SEQ ID NO: 8806

SEQ ID NO: 8929 - DNA, 201 bp, Homo sapiens; identical to SEQ ID NO: 8807

SEQ ID NO: 8930 - DNA, 201 bp, Homo sapiens; identical to SEQ ID NO: 8808

SEQ ID NO: 8931 - DNA, 201 bp, Homo sapiens; identical to SEQ ID NO: 8809

SEQ ID NO: 8932 - DNA, 201 bp, Homo sapiens; identical to SEQ ID NO: 8810

SEQ ID NO: 8933 - DNA, 201 bp, Homo sapiens; identical to SEQ ID NO: 8811

SEQ ID NO: 8934 - DNA, 201 bp, Homo sapiens; identical to SEQ ID NO: 8812

SEQ ID NO: 8935 - DNA, 201 bp, Homo sapiens; identical to SEQ ID NO: 8813

SEQ ID NO: 8936 - DNA, 201 bp, Homo sapiens; identical to SEQ ID NO: 8814

SEQ ID NO: 8937 - DNA, 201 bp, Homo sapiens; identical to SEQ ID NO: 8815

SEQ ID NO: 8938 - DNA, 201 bp, Homo sapiens; identical to SEQ ID NO: 8816

SEQ ID NO: 8939 - DNA, 201 bp, Homo sapiens; identical to SEQ ID NO: 8817

SEQ ID NO: 8940 - DNA, 201 bp, Homo sapiens; identical to SEQ ID NO: 8818

SEQ ID NO: 8941 - DNA, 201 bp, Homo sapiens; identical to SEQ ID NO: 8819

SEQ ID NO: 8942 - DNA, 201 bp, Homo sapiens; identical to SEQ ID NO: 8820

SEQ ID NO: 8943 - DNA, 201 bp, Homo sapiens; identical to SEQ ID NO: 8821

SEQ ID NO: 8944 - DNA, 201 bp, Homo sapiens; identical to SEQ ID NO: 8822

SEQ ID NO: 8945 - DNA, 201 bp, Homo sapiens; identical to SEQ ID NO: 8823

SEQ ID NO: 8946 - DNA, 201 bp, Homo sapiens
gggcgagcggctgcgcgcgcggatggaggagatgggcagccggacccgcgaccgcctggacgaggtgaaggagcaggtggcggaggtgcgcgccaagctgraggagcaggcccagcagatacgcctgcaggccgaggccttccaggcccgcctcaagagctggttcgagcccctggtggaagacatgcagcgccagtgggc

SEQ ID NO: 8947 - DNA, 201 bp, Homo sapiens
ggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcggccagagcaccgaggagctgcgggtgcgcctcgcctcccacctgcgcaagctgcg

SEQ ID NO: 8948 - DNA, 201 bp, Homo sapiens
gcgcggccgcctggtgcagtaccgcggcgaggtgcaggccatgctcggccagagcaccgaggagctgcgggtgcgcctcgcctcccacctgcgcaagctgygtaagcggctcctccgcgatgccgatgacctgcagaagcgcctggcagtgtaccaggccggggcccgcgagggcgccgagcgcggcctcagcgccatccg

SEQ ID NO: 8949 - DNA, 201 bp, Homo sapiens
gaggacgtgcgcggccgcctggtgcagtaccgcggcgaggtgcaggccatgctcggccagagcaccgaggagctgcgggtgcgcctcgcctcccacctgckcaagctgcgtaagcggctcctccgcgatgccgatgacctgcagaagcgcctggcagtgtaccaggccggggcccgcgagggcgccgagcgcggcctcagc

SEQ ID NO: 8950 - DNA, 201 bp, Homo sapiens
aggcaggaagatgaaggttctgtgggctgcgttgctggtcacattcctggcaggatgccaggccaaggtggagcaagcggtggagacagagccggagcccragctgcgccagcagaccgagtggcagagcggccagcgctgggaactggcactgggtcgcttttgggattacctgcgctgggtgcagacactgtctgagca

SEQ ID NO: 8951 - DNA, 201 bp, Homo sapiens
cgcggccgcctggtgcagtaccgcggcgaggtgcaggccatgctcggccagagcaccgaggagctgcgggtgcgcctcgcctcccacctgcgcaagctgcstaagcggctcctccgcgatgccgatgacctgcagaagcgcctggcagtgtaccaggccggggcccgcgagggcgccgagcgcggcctcagcgccatccgc

SEQ ID NO: 8952 - DNA, 201 bp, Homo sapiens
catgctcggccagagcaccgaggagctgcgggtgcgcctcgcctcccacctgcgcaagctgcgtaagcggctcctccgcgatgccgatgacctgcagaagygcctggcagtgtaccaggccggggcccgcgagggcgccgagcgcggcctcagcgccatccgcgagcgcctggggcccctggtggaacagggccgcgtgcg

SEQ ID NO: 8953 - DNA, 201 bp, Homo sapiens
atccgcgagcgcctggggcccctggtggaacagggccgcgtgcgggccgccactgtgggctccctggccggccagccgctacaggagcgggcccaggcctrgggcgagcggctgcgcgcgcggatggaggagatgggcagccggacccgcgaccgcctggacgaggtgaaggagcaggtggcggaggtgcgcgccaagctg

SEQ ID NO: 8954 - DNA, 201 bp, Homo sapiens
ctggcaggatgccaggccaaggtggagcaagcggtggagacagagccggagcccgagctgcgccagcagaccgagtggcagagcggccagcgctgggaacyggcactgggtcgcttttgggattacctgcgctgggtgcagacactgtctgagcaggtgcaggaggagctgctcagctcccaggtcacccaggaactgagg

SEQ ID NO: 8955 - DNA, 201 bp, Homo sapiens
ggtcacattcctggcaggatgccaggccaaggtggagcaagcggtggagacagagccggagcccgagctgcgccagcagaccgagtggcagagcggccagygctgggaactggcactgggtcgcttttgggattacctgcgctgggtgcagacactgtctgagcaggtgcaggaggagctgctcagctcccaggtcaccca

SEQ ID NO: 8956 - DNA, 201 bp, Homo sapiens
cggctgggcgcggacatggaggacgtgcgcggccgcctggtgcagtaccgcggcgaggtgcaggccatgctcggccagagcaccgaggagctgcgggtgcrcctcgcctcccacctgcgcaagctgcgtaagcggctcctccgcgatgccgatgacctgcagaagcgcctggcagtgtaccaggccggggcccgcgagggc

SEQ ID NO: 8957 - DNA, 201 bp, Homo sapiens
tccaaggagctgcaggcggcgcaggcccggctgggcgcggacatggaggacgtgcgcggccgcctggtgcagtaccgcggcgaggtgcaggccatgctcgrccagagcaccgaggagctgcgggtgcgcctcgcctcccacctgcgcaagctgcgtaagcggctcctccgcgatgccgatgacctgcagaagcgcctggca

SEQ ID NO: 8958 - DNA, 201 bp, Homo sapiens
ggaggacgtgcgcggccgcctggtgcagtaccgcggcgaggtgcaggccatgctcggccagagcaccgaggagctgcgggtgcgcctcgcctcccacctgygcaagctgcgtaagcggctcctccgcgatgccgatgacctgcagaagcgcctggcagtgtaccaggccggggcccgcgagggcgccgagcgcggcctcag

SEQ ID NO: 8959 - DNA, 201 bp, Homo sapiens
cggccgcctggtgcagtaccgcggcgaggtgcaggccatgctcggccagagcaccgaggagctgcgggtgcgcctcgcctcccacctgcgcaagctgcgtvagcggctcctccgcgatgccgatgacctgcagaagcgcctggcagtgtaccaggccggggcccgcgagggcgccgagcgcggcctcagcgccatccgcga

SEQ ID NO: 8960 - DNA, 201 bp, Homo sapiens
gggctgcgttgctggtcacattcctggcaggatgccaggccaaggtggagcaagcggtggagacagagccggagcccgagctgcgccagcagaccgagtgrcagagcggccagcgctgggaactggcactgggtcgcttttgggattacctgcgctgggtgcagacactgtctgagcaggtgcaggaggagctgctcagct

SEQ ID NO: 8961 - DNA, 201 bp, Homo sapiens
tgacctgcagaagcgcctggcagtgtaccaggccggggcccgcgagggcgccgagcgcggcctcagcgccatccgcgagcgcctggggcccctggtggaasagggccgcgtgcgggccgccactgtgggctccctggccggccagccgctacaggagcgggcccaggcctggggcgagcggctgcgcgcgcggatggagga

SEQ ID NO: 8962 - DNA, 201 bp, Homo sapiens
ccggctgggcgcggacatggaggacgtgcgcggccgcctggtgcagtaccgcggcgaggtgcaggccatgctcggccagagcaccgaggagctgcgggtghgcctcgcctcccacctgcgcaagctgcgtaagcggctcctccgcgatgccgatgacctgcagaagcgcctggcagtgtaccaggccggggcccgcgaggg

SEQ ID NO: 8963 - DNA, 201 bp, Homo sapiens
tgtgggctccctggccggccagccgctacaggagcgggcccaggcctggggcgagcggctgcgcgcgcggatggaggagatgggcagccggacccgcgacygcctggacgaggtgaaggagcaggtggcggaggtgcgcgccaagctggaggagcaggcccagcagatacgcctgcaggccgaggccttccaggcccgcct

SEQ ID NO: 8964 - DNA, 201 bp, Homo sapiens
gcggctcctccgcgatgccgatgacctgcagaagcgcctggcagtgtaccaggccggggcccgcgagggcgccgagcgcggcctcagcgccatccgcgagygcctggggcccctggtggaacagggccgcgtgcgggccgccactgtgggctccctggccggccagccgctacaggagcgggcccaggcctggggcgagcg

SEQ ID NO: 8965 - DNA, 201 bp, Homo sapiens
ccacggtgaaagacagtggagattacgaatgtgctgcccgccaggctaccagggaggtcaaagaaatgaagaaagtcactatttctgtccatgagaaaggkttcattgaaatcaaacccaccttcagccagttggaagctgtcaacctgcatgaagtcaaacattttgttgtagaggtgcgggcctacccacctcccagga

SEQ ID NO: 8966 - DNA, 201 bp, Homo sapiens
tctctgagatgctttggggagagtgaagtgagctggcagtaccccatgtctgaagaagagagctccgatgtggaaatcagaaatgaagaaaacaacagcgrcctttttgtgacggtcttggaagtgagcagtgcctcggcggcccacacagggttgtacacttgctattacaaccacactcagacagaagagaatgagctt

SEQ ID NO: 8967 - DNA, 201 bp, Homo sapiens
aaaatgaaaaggttgtgcagctgaattcatccttttctctgagatgctttggggagagtgaagtgagctggcagtaccccatgtctgaagaagagagctcygatgtggaaatcagaaatgaagaaaacaacagcggcctttttgtgacggtcttggaagtgagcagtgcctcggcggcccacacagggttgtacacttgct

SEQ ID NO: 8968 - DNA, 201 bp, Homo sapiens
ctttattggatttgttgagcttcacctatcaagttgcccgaggaatggagtttttggcttcaaaaaattgtgtccaccgtgatctggctgctcgcaacgtyctcctggcacaaggaaaaattgtgaagatctgtgactttggcctggccagagacatcatgcatgattcgaactatgtgtcgaaaggcagtacctttctgc

SEQ ID NO: 8969 - DNA, 201 bp, Homo sapiens
gccttgcatgacatcatgaggccggatgaaacttctcagtccagcagtttccagtcctaacaaatgctcccacctgaatttgtatatgactgcatttgtgkgtgtgtgtgtgttttcagcaaattccagatttgtttccttttggcctcctgcaaagtctccagaagaaaatttgccaatctttcctactttctattttta

SEQ ID NO: 8970 - DNA, 201 bp, Homo sapiens
cctacgacagcagacagggctttaatgggaccttcactgtagggccctatatctgtgaggccaccgtcaaaggaaagaagttccagaccatcccatttaaygtttatgctttaaaagcaacatcagagctggatctagaaatggaagctcttaaaaccgtgtataagtcaggggaaacgattgtggtcacctgtgctgttt

SEQ ID NO: 8971 - DNA, 201 bp, Homo sapiens
atgaatatatttatgtggacccgatgcagctgccttatgactcaagatgggagtttccaagagatggactagtgcttggtcgggtcttggggtctggagcrtttgggaaggtggttgaaggaacagcctatggattaagccggtcccaacctgtcatgaaagttgcagtgaagatgctaaaacccacggccagatccagtg

SEQ ID NO: 8972 - DNA, 201 bp, Homo sapiens
taaaacaatccttactaagtaggtgatgagtttgacagtttttgacatttatattaaataacatgtttctctataaagtatggtaatagctttagtgaatyaaatttagttgagcatagagaacaaagtaaaagtagtgttgtccaggaagtcagaatttttaactgtactgaataggttccccaatccatcgtattaaaa

SEQ ID NO: 8973 - DNA, 201 bp, Homo sapiens
ggtgaactttgtgcttcaaggacattggtgagagtccaacagacacaatttatactgcgacagaacttcagcattgtaattatgtaaataactctaaccamggctgtgtttagattgtattaactatcttctttggacttctgaagagaccactcaatccatccatgtacttccctcttgaaacctgatgtcagctgctgt

SEQ ID NO: 8974 - DNA, 201 bp, Homo sapiens
tgttggtgattgtgatcatctcacttattgtcctggttgtcatttggaaacagaaaccgaggtatgaaattcgctggagggtcattgaatcaatcagcccrgatggacatgaatatatttatgtggacccgatgcagctgccttatgactcaagatgggagtttccaagagatggactagtgcttggtcgggtcttggggt

SEQ ID NO: 8975 - DNA, 201 bp, Homo sapiens
cctacccacctcccaggatatcctggctgaaaaacaatctgactctgattgaaaatctcactgagatcaccactgatgtggaaaagattcaggaaataagstatcgaagcaaattaaagctgatccgtgctaaggaagaagacagtggccattatactattgtagctcaaaatgaagatgctgtgaagagctatacttttg

SEQ ID NO: 8976 - DNA, 201 bp, Homo sapiens
gctcgcagacctctgaagagagtgccattgagacgggttccagcagttccaccttcatcaagagagaggacgagaccattgaagacatcgacatgatggaygacatcggcatagactcttcagacctggtggaagacagcttcctgtaactggcggattcgaggggttccttccacttctggggccacctctggatcccgt

SEQ ID NO: 8977 - DNA, 201 bp, Homo sapiens
tggtggaagacagcttcctgtaactggcggattcgaggggttccttccacttctggggccacctctggatcccgttcagaaaaccactttattgcaatgcrgaggttgagaggaggacttggttgatgtttaaagagaagttcccagccaagggcctcggggagcgttctaaatatgaatgaatgggatattttgaaatga

SEQ ID NO: 8978 - DNA, 201 bp, Homo sapiens
ctccctggctgttctgatcggccagttttcggaaacactgacttaggtttcaggaagttgccatgggaaacaaataatttgaactttggaacagggttggmattcaaccacgcaggaagcctactatttaaatccttggcttcaggttagtgacatttaatgccatctagctagcaattgcgaccttaatttaactttcca

SEQ ID NO: 8979 - DNA, 143 bp, Homo sapiens
cctacgacagcagacagggctttaatgggaccttcactgtagggccctatatctgtgaggccaccgtcaaaggaaagaagttccagaccatcccatttaaygtttatgctttaaaaggtacttgtatcatctccttccttctt

SEQ ID NO: 8980 - DNA, 201 bp, Homo sapiens; identical to SEQ ID NO: 8966

SEQ ID NO: 8981 - DNA, 201 bp, Homo sapiens; identical to SEQ ID NO: 8967

SEQ ID NO: 8982 - DNA, 201 bp, Homo sapiens
tccctttgccgccggggacgcttgctccctccctgccccctacacggcgtccctcaggcgcccccattccggaccagccctcgggagtcgccgacccggcytcccgcaaagacttttccccagacctcgggcgcaccccctgcacgccgccttcatccccggcctgtctcctgagcccccgcgcatcctagaccctttctc

SEQ ID NO: 8983 - DNA, 165 bp, Homo sapiens
ccagccggtccccgccgccgccgcccttcgcgccctgggccatctccctcccacctccctccgcsgagcagccagacagcgagggccccggccgggggcaggggggacgccccgtccggggcacccccccggctctgagccgcccgcggggccggcctcggcccg

SEQ ID NO: 8984 - DNA, 201 bp, Homo sapiens
ggccatccgcggccagatcctgtccaagctgcggctcgccagccccccgagccagggggaggtgccgcccggcccgctgcccgaggccgtgctcgccctgyacaacagcacccgcgaccgggtggccggggagagtgcagaaccggagcccgagcctgaggccgactactacgccaaggaggtcacccgcgtgctaatggt

SEQ ID NO: 8985 - DNA, 160 bp, Homo sapiens
ccagccggtccccgccgccgccgcccttcgcgccctgggccatctccctcccacctcccwccgcggagcagccagacagcgagggccccggccgggggcaggggggacgccccgtccggggcacccccccggctctgagccgcccgcggggccggcctcg

SEQ ID NO: 8986 - DNA, 159 bp, Homo sapiens
ccagccggtccccgccgccgccgcccttcgcgccctgggccatctccctcccacctccytccgcggagcagccagacagcgagggccccggccgggggcaggggggacgccccgtccggggcacccccccggctctgagccgcccgcggggccggcctc

SEQ ID NO: 8987 - DNA, 201 bp, Homo sapiens
ccgctgctgtggctactggtgctgacgcctggccggccggccgcgggactatccacctgcaagactatcgacatggagctggtgaagcggaagcgcatcgrggccatccgcggccagatcctgtccaagctgcggctcgccagccccccgagccagggggaggtgccgcccggcccgctgcccgaggccgtgctcgccctg

SEQ ID NO: 8988 - DNA, 135 bp, Homo sapiens
ccagccggtccccgccgccgccgcccttcgcgccmtgggccatctccctcccacctccctccgcggagcagccagacagcgagggccccggccgggggcaggggggacgccccgtccggggcacccccccggctc

SEQ ID NO: 8989 - DNA, 201 bp, Homo sapiens
tcaagaccacccaccttctggtaccagatcgcgcccatctaggttatttccgtgggatactgagacacccccggtccaagcctcccctccaccactgcgcycttctccctgaggacctcagctttccctcgaggccctcctaccttttgccgggagacccccagcccctgcaggggcggggcctccccaccacaccagccc

SEQ ID NO: 8990 - DNA, 201 bp, Homo sapiens
cctgcacgccgccttcatccccggcctgtctcctgagcccccgcgcatcctagaccctttctcctccaggagacggatctctctccgacctgccacagatmccctattcaagaccacccaccttctggtaccagatcgcgcccatctaggttatttccgtgggatactgagacacccccggtccaagcctcccctccacca

SEQ ID NO: 8991 - DNA, 201 bp, Homo sapiens
acttttccccagacctcgggcgcaccccctgcacgccgccttcatccccggcctgtctcctgagcccccgcgcatcctagaccctttctcctccaggagamggatctctctccgacctgccacagatcccctattcaagaccacccaccttctggtaccagatcgcgcccatctaggttatttccgtgggatactgagaca

SEQ ID NO: 8992 - DNA, 201 bp, Homo sapiens
aacacactgcaagtggacatcaacgggttcactaccggccgccgaggtgacctggccaccattcatggcatgaaccggcctttcctgcttctcatggccaycccgctggagagggcccagcatctgcaaagctcccggcaccgccgagccctggacaccaactattgcttcagctccacggagaagaactgctgcgtgcgg

SEQ ID NO: 8993 - DNA, 201 bp, Homo sapiens
tgagccgtggaggggaaattgagggctttcgccttagcgcccactgctcctgtgacagcagggataacacactgcaagtggacatcaacgggttcactacmggccgccgaggtgacctggccaccattcatggcatgaaccggcctttcctgcttctcatggccaccccgctggagagggcccagcatctgcaaagctccc

SEQ ID NO: 8994 - DNA, 201 bp, Homo sapiens
agaactgctgcgtgcggcagctgtacattgacttccgcaaggacctcggctggaagtggatccacgagcccaagggctaccatgccaacttctgcctcggrccctgcccctacatttggagcctggacacgcagtacagcaaggtcctggccctgtacaaccagcataacccgggcgcctcggcggcgccgtgctgcgtgc

SEQ ID NO: 8995 - DNA, 201 bp, Homo sapiens
ggcagtgccggggggcgccgcctcccccatgccgccctccgggctgcggctgctgctgctgctgctaccgctgctgtggctactggtgctgacgcctggcsggccggccgcgggactatccacctgcaagactatcgacatggagctggtgaagcggaagcgcatcgaggccatccgcggccagatcctgtccaagctgcg

SEQ ID NO: 8996 - DNA, 201 bp, Homo sapiens
tcgaggccctcctaccttttgccgggagacccccagcccctgcaggggcggggcctccccaccacaccagccctgttcgcgctctcggcagtgccgggggrcgccgcctcccccatgccgccctccgggctgcggctgctgctgctgctgctaccgctgctgtggctactggtgctgacgcctggccggccggccgcggga

SEQ ID NO: 8997 - DNA, 201 bp, Homo sapiens
caagttcaagcagagtacacacagcatatatatgttcttcaacacatcagagctccgagaagcggtacctgaacccgtgttgctctcccgggcagagctgygtctgctgaggctcaagttaaaagtggagcagcacgtggagctgtaccagaaatacagcaacaattcctggcgatacctcagcaaccggctgctggcacc

SEQ ID NO: 8998 - DNA, 201 bp, Homo sapiens
gcagtgccggggggcgccgcctcccccatgccgccctccgggctgcggctgctgctgctgctgctaccgctgctgtggctactggtgctgacgcctggccsgccggccgcgggactatccacctgcaagactatcgacatggagctggtgaagcggaagcgcatcgaggccatccgcggccagatcctgtccaagctgcgg

SEQ ID NO: 8999 - DNA, 201 bp, Homo sapiens
cggctgctggcacccagcgactcgccagagtggttatcttttgatgtcaccggagttgtgcggcagtggttgagccgtggaggggaaattgagggctttcrccttagcgcccactgctcctgtgacagcagggataacacactgcaagtggacatcaacgggttcactaccggccgccgaggtgacctggccaccattcat

SEQ ID NO: 9000 - DNA, 201 bp, Homo sapiens
caggggcggggcctccccaccacaccagccctgttcgcgctctcggcagtgccggggggcgccgcctcccccatgccgccctccgggctgcggctgctgcygctgctgctaccgctgctgtggctactggtgctgacgcctggccggccggccgcgggactatccacctgcaagactatcgacatggagctggtgaagcgg

SEQ ID NO: 9001 - DNA, 201 bp, Homo sapiens
ccggctgctggcacccagcgactcgccagagtggttatcttttgatgtcaccggagttgtgcggcagtggttgagccgtggaggggaaattgagggctttygccttagcgcccactgctcctgtgacagcagggataacacactgcaagtggacatcaacgggttcactaccggccgccgaggtgacctggccaccattca

SEQ ID NO: 9002 - DNA, 201 bp, Homo sapiens; identical to SEQ ID NO: 8982

SEQ ID NO: 9003 - DNA, 165 bp, Homo sapiens; identical to SEQ ID NO: 8983

SEQ ID NO: 9004 - DNA, 201 bp, Homo sapiens; identical to SEQ ID NO: 8984

SEQ ID NO: 9005 - DNA, 160 bp, Homo sapiens; identical to SEQ ID NO: 8985

SEQ ID NO: 9006 - DNA, 159 bp, Homo sapiens; identical to SEQ ID NO: 8986

SEQ ID NO: 9007 - DNA, 201 bp, Homo sapiens; identical to SEQ ID NO: 8987

SEQ ID NO: 9008 - DNA, 135 bp, Homo sapiens; identical to SEQ ID NO: 8988

SEQ ID NO: 9009 - DNA, 201 bp, Homo sapiens; identical to SEQ ID NO: 8989

SEQ ID NO: 9010 - DNA, 201 bp, Homo sapiens; identical to SEQ ID NO: 8990

SEQ ID NO: 9011 - DNA, 201 bp, Homo sapiens; identical to SEQ ID NO: 8991

SEQ ID NO: 9012 - DNA, 201 bp, Homo sapiens; identical to SEQ ID NO: 8992

SEQ ID NO: 9013 - DNA, 201 bp, Homo sapiens; identical to SEQ ID NO: 8993

SEQ ID NO: 9014 - DNA, 201 bp, Homo sapiens; identical to SEQ ID NO: 8994

SEQ ID NO: 9015 - DNA, 201 bp, Homo sapiens; identical to SEQ ID NO: 8995

SEQ ID NO: 9016 - DNA, 201 bp, Homo sapiens; identical to SEQ ID NO: 8996

SEQ ID NO: 9017 - DNA, 201 bp, Homo sapiens; identical to SEQ ID NO: 8997

SEQ ID NO: 9018 - DNA, 201 bp, Homo sapiens; identical to SEQ ID NO: 8998

SEQ ID NO: 9019 - DNA, 201 bp, Homo sapiens; identical to SEQ ID NO: 8999

SEQ ID NO: 9020 - DNA, 201 bp, Homo sapiens; identical to SEQ ID NO: 9000

SEQ ID NO: 9021 - DNA, 201 bp, Homo sapiens; identical to SEQ ID NO: 9001

SEQ ID NO: 9022 - DNA, 201 bp, Homo sapiens
accttagtgaactctcagctactggaagaaatctccaagtatccagggttttacaaagaacagtgattgaagttgatgaaaggggcactgaggcagtggcrggaatcttgtcagaaattactgcttattccatgcctcctgtcatcaaagtggaccggccatttcatttcatgatctatgaagaaacctctggaatgcttc

SEQ ID NO: 9023 - DNA, 201 bp, Homo sapiens
tttcctacacatacatacctatgataaagtttaatttataaattaggcacagtaagagattaacaataataacaacattaagtaaaatgagttacttgaaygcaagcactgcaataccataacagtcaaactgattatagagaaggctactaagtgactcatgggcgaggagcatagacagtgtggagacattgggcaagg

SEQ ID NO: 9024 - DNA, 201 bp, Homo sapiens
agtggcaggtgagctggtgattccttactgcccaggttctgtctaggaaggtgcgtcctcaccatgctggatggtgtcctagtccaggagcaccccctgarctcctggcctagactccaaagggttgggtagatgagcaaagactttacaaagaccttaggcgatatatgtccaggagcacccaggaattactgggctacc

SEQ ID NO: 9025 - DNA, 201 bp, Homo sapiens
cagggctgagaagtggcaggtgagctggtgattccttactgcccaggttctgtctaggaaggtgcgtcctcaccatgctggatggtgtcctagtccaggakcaccccctgagctcctggcctagactccaaagggttgggtagatgagcaaagactttacaaagaccttaggcgatatatgtccaggagcacccaggaatt

SEQ ID NO: 9026 - DNA, 201 bp, Homo sapiens
agtggaccggccatttcatttcatgatctatgaagaaacctctggaatgcttctgtttctgggcagggtggtgaatccgactctcctataattcaggacaygcataagcacttcgtgctgtagtagatgctgaatctgaggtatcaaacacacacaggataccagcaatggatggcaggggagagtgttccttttgttctt

SEQ ID NO: 9027 - DNA, 201 bp, Homo sapiens
atagagaaggctactaagtgactcatgggcgaggagcatagacagtgtggagacattgggcaaggggagaattcacatcctgggtgggacagagcaggacratgcaagattccatcccactactcagaatggcatgctgcttaagacttttagattgtttatttctggaatttttcatttaatgtttttggaccatggttg

SEQ ID NO: 9028 - DNA, 201 bp, Homo sapiens
gcctccgcagccgatcacatgaaggtggtgccaagtctcctgctctccgtcctcctggcacaggtgtggctggtacccggcttggcccccagtcctcagtygccagagaccccagcccctcagaaccagaccagcagggtagtgcaggctcccaaggaggaagaggaagatgagcaggaggccagcgaggagaaggccagt

SEQ ID NO: 9029 - DNA, 201 bp, Homo sapiens
gggggaaaattcccaaactgtttgatgagattaatcctgaaaccaaattaattcttgtggattacatcttgttcaaagggaaatggttgaccccatttgaycctgtcttcaccgaagtcgacactttccacctggacaagtacaagaccattaaggtgcccatgatgtacggtgcaggcaagtttgcctccacctttgaca

SEQ ID NO: 9030 - DNA, 120 bp, Homo sapiens
ctggagtggggtaagaggcraattatagacacaaggggctcctctgcaggaaggaggccaagggaaagaggcttgaaaggcttgatatttcacccaccaccactcactgccggagtaagc

SEQ ID NO: 9031 - DNA, 201 bp, Homo sapiens
ggccagcgaggagaaggccagtgaggaagagaaagcctggctgatggccagcaggcagcagcttgccaaggagacttcaaacttcggattcagcctgctgygaaagatctccatgaggcacgatggcaacatggtcttctctccatttggcatgtccttggccatgacaggcttgatgctgggggccacagggccgactga

SEQ ID NO: 9032 - DNA, 201 bp, Homo sapiens
gtcgccagagaccccagcccctcagaaccagaccagcagggtagtgcaggctcccaaggaggaagaggaagatgagcaggaggccagcgaggagaaggccrgtgaggaagagaaagcctggctgatggccagcaggcagcagcttgccaaggagacttcaaacttcggattcagcctgctgcgaaagatctccatgaggca

SEQ ID NO: 9033 - DNA, 201 bp, Homo sapiens
tgttcaaagggaaatggttgaccccatttgaccctgtcttcaccgaagtcgacactttccacctggacaagtacaagaccattaaggtgcccatgatgtayggtgcaggcaagtttgcctccacctttgacaagaattttcgttgtcatgtcctcaaactgccctaccaaggaaatgccaccatgctggtggtcctcatgg

SEQ ID NO: 9034 - DNA, 201 bp, Homo sapiens
ctggcacaggtgtggctggtacccggcttggcccccagtcctcagtcgccagagaccccagcccctcagaaccagaccagcagggtagtgcaggctcccarggaggaagaggaagatgagcaggaggccagcgaggagaaggccagtgaggaagagaaagcctggctgatggccagcaggcagcagcttgccaaggagact

SEQ ID NO: 9035 - DNA, 201 bp, Homo sapiens
gttcaaagggaaatggttgaccccatttgaccctgtcttcaccgaagtcgacactttccacctggacaagtacaagaccattaaggtgcccatgatgtacrgtgcaggcaagtttgcctccacctttgacaagaattttcgttgtcatgtcctcaaactgccctaccaaggaaatgccaccatgctggtggtcctcatgga

SEQ ID NO: 9036 - DNA, 201 bp, Homo sapiens
gggagttttgccttcatccacaaggattttgatgtcaaagagactttcttcaatttatccaagaggtattttgatacagagtgcgtgcctatgaattttcrcaatgcctcacaggccaaaaggctcatgaatcattacattaacaaagagactcgggggaaaattcccaaactgtttgatgagattaatcctgaaaccaaa

SEQ ID NO: 9037 - DNA, 201 bp, Homo sapiens
aagagagggctccacttgcaggccctgaagcccaccaagcccgggctcctgccttccctctttaagggactcagagagaccctctcccgcaacctggaacwgggcctcacacaggggagttttgccttcatccacaaggattttgatgtcaaagagactttcttcaatttatccaagaggtattttgatacagagtgcgtg

SEQ ID NO: 9038 - DNA, 201 bp, Homo sapiens
ctgcttaggcagatgggaatcagaagaatcttctcaccctttgctgaccttagtgaactctcagctactggaagaaatctccaagtatccagggttttacraagaacagtgattgaagttgatgaaaggggcactgaggcagtggcaggaatcttgtcagaaattactgcttattccatgcctcctgtcatcaaagtggac

SEQ ID NO: 9039 - DNA, 201 bp, Homo sapiens
ggagcacccaggaattactgggctaccactgcagactgcaggacaagctccaagaacaggaaggaagtcttgcagctgaagggaggcactccttggcctcsgcagccgatcacatgaaggtggtgccaagtctcctgctctccgtcctcctggcacaggtgtggctggtacccggcttggcccccagtcctcagtcgccag

SEQ ID NO: 9040 - DNA, 201 bp, Homo sapiens
cagactgcaggacaagctccaagaacaggaaggaagtcttgcagctgaagggaggcactccttggcctccgcagccgatcacatgaaggtggtgccaagtmtcctgctctccgtcctcctggcacaggtgtggctggtacccggcttggcccccagtcctcagtcgccagagaccccagcccctcagaaccagaccagcag

SEQ ID NO: 9041 - DNA, 201 bp, Homo sapiens
gctccacttgcaggccctgaagcccaccaagcccgggctcctgccttccctctttaagggactcagagagaccctctcccgcaacctggaactgggcctcwcacaggggagttttgccttcatccacaaggattttgatgtcaaagagactttcttcaatttatccaagaggtattttgatacagagtgcgtgcctatgaa

SEQ ID NO: 9042 - DNA, 201 bp, Homo sapiens
agctgaagggaggcactccttggcctccgcagccgatcacatgaaggtggtgccaagtctcctgctctccgtcctcctggcacaggtgtggctggtacccrgcttggcccccagtcctcagtcgccagagaccccagcccctcagaaccagaccagcagggtagtgcaggctcccaaggaggaagaggaagatgagcagga

SEQ ID NO: 9043 - DNA, 201 bp, Homo sapiens
ctgtttgatgagattaatcctgaaaccaaattaattcttgtggattacatcttgttcaaagggaaatggttgaccccatttgaccctgtcttcaccgaagycgacactttccacctggacaagtacaagaccattaaggtgcccatgatgtacggtgcaggcaagtttgcctccacctttgacaagaattttcgttgtcat

SEQ ID NO: 9044 - DNA, 201 bp, Homo sapiens; identical to SEQ ID NO: 9028

SEQ ID NO: 9045 - DNA, 201 bp, Homo sapiens; identical to SEQ ID NO: 9031

SEQ ID NO: 9046 - DNA, 201 bp, Homo sapiens; identical to SEQ ID NO: 9037

SEQ ID NO: 9047 - DNA, 201 bp, Homo sapiens
aagctgaagctttggtttctgctctaaatgaaggacttttccaggacccaaggccacacactggaagtcttgcagctgaagggaggcactccttggcctcsgcagccgatcacatgaaggtggtgccaagtctcctgctctccgtcctcctggcacaggtgtggctggtacccggcttggcccccagtcctcagtcgccag

SEQ ID NO: 9048 - DNA, 201 bp, Homo sapiens; identical to SEQ ID NO: 9041

SEQ ID NO: 9049 - DNA, 201 bp, Homo sapiens; identical to SEQ ID NO: 9043

SEQ ID NO: 9050 - DNA, 201 bp, Homo sapiens; identical to SEQ ID NO: 9022

SEQ ID NO: 9051 - DNA, 201 bp, Homo sapiens; identical to SEQ ID NO: 9026

SEQ ID NO: 9052 - DNA, 201 bp, Homo sapiens; identical to SEQ ID NO: 9027

SEQ ID NO: 9053 - DNA, 201 bp, Homo sapiens; identical to SEQ ID NO: 9029

SEQ ID NO: 9054 - DNA, 201 bp, Homo sapiens; identical to SEQ ID NO: 9033

SEQ ID NO: 9055 - DNA, 201 bp, Homo sapiens; identical to SEQ ID NO: 9032

SEQ ID NO: 9056 - DNA, 201 bp, Homo sapiens; identical to SEQ ID NO: 9035

SEQ ID NO: 9057 - DNA, 201 bp, Homo sapiens; identical to SEQ ID NO: 9036

SEQ ID NO: 9058 - DNA, 201 bp, Homo sapiens; identical to SEQ ID NO: 9034

SEQ ID NO: 9059 - DNA, 201 bp, Homo sapiens; identical to SEQ ID NO: 9038

SEQ ID NO: 9060 - DNA, 201 bp, Homo sapiens
aggacttttccaggacccaaggccacacactggaagtcttgcagctgaagggaggcactccttggcctccgcagccgatcacatgaaggtggtgccaagtmtcctgctctccgtcctcctggcacaggtgtggctggtacccggcttggcccccagtcctcagtcgccagagaccccagcccctcagaaccagaccagcag

SEQ ID NO: 9061 - DNA, 201 bp, Homo sapiens; identical to SEQ ID NO: 9042

SEQ ID NO: 9062 - DNA, 201 bp, Homo sapiens; identical to SEQ ID NO: 9028

SEQ ID NO: 9063 - DNA, 201 bp, Homo sapiens; identical to SEQ ID NO: 9031

SEQ ID NO: 9064 - DNA, 201 bp, Homo sapiens; identical to SEQ ID NO: 9037

SEQ ID NO: 9065 - DNA, 201 bp, Homo sapiens; identical to SEQ ID NO: 9047

SEQ ID NO: 9066 - DNA, 201 bp, Homo sapiens; identical to SEQ ID NO: 9041

SEQ ID NO: 9067 - DNA, 201 bp, Homo sapiens; identical to SEQ ID NO: 9043

SEQ ID NO: 9068 - DNA, 201 bp, Homo sapiens; identical to SEQ ID NO: 9022

SEQ ID NO: 9069 - DNA, 201 bp, Homo sapiens; identical to SEQ ID NO: 9023

SEQ ID NO: 9070 - DNA, 201 bp, Homo sapiens; identical to SEQ ID NO: 9026

SEQ ID NO: 9071 - DNA, 201 bp, Homo sapiens; identical to SEQ ID NO: 9027

SEQ ID NO: 9072 - DNA, 201 bp, Homo sapiens; identical to SEQ ID NO: 9029

SEQ ID NO: 9073 - DNA, 201 bp, Homo sapiens; identical to SEQ ID NO: 9033

SEQ ID NO: 9074 - DNA, 201 bp, Homo sapiens; identical to SEQ ID NO: 9032

SEQ ID NO: 9075 - DNA, 201 bp, Homo sapiens; identical to SEQ ID NO: 9035

SEQ ID NO: 9076 - DNA, 201 bp, Homo sapiens; identical to SEQ ID NO: 9036

SEQ ID NO: 9077 - DNA, 201 bp, Homo sapiens; identical to SEQ ID NO: 9034

SEQ ID NO: 9078 - DNA, 201 bp, Homo sapiens; identical to SEQ ID NO: 9038

SEQ ID NO: 9079 - DNA, 201 bp, Homo sapiens; identical to SEQ ID NO: 9060

SEQ ID NO: 9080 - DNA, 201 bp, Homo sapiens; identical to SEQ ID NO: 9042

SEQ ID NO: 9081 - DNA, 201 bp, Homo sapiens
gtcaaccacgtgtcccttatccttagctatgccaacagctgcgccaaccccattctctatggcttcctctccgacaacttccgccgattcttccagcgggytctctgcctgcgctgctgcctcctggaaggtgctggaggtgctgaggaggagcccctggactactatgccactgctctcaagagcaaagtgtggcttgtg

SEQ ID NO: 9082 - DNA, 201 bp, Homo sapiens
ctcggagaagaaaatcaccaggctgccttgatgccaccgtcaaccacgtgtcccttatccttagctatgccaacagctgcgccaaccccattctctatggyttcctctccgacaacttccgccgattcttccagcgggttctctgcctgcgctgctgcctcctggaaggtgctggaggtgctgaggaggagcccctggact

SEQ ID NO: 9083 - DNA, 201 bp, Homo sapiens
cttgatgccaccgtcaaccacgtgtcccttatccttagctatgccaacagctgcgccaaccccattctctatggcttcctctccgacaacttccgccgatycttccagcgggttctctgcctgcgctgctgcctcctggaaggtgctggaggtgctgaggaggagcccctggactactatgccactgctctcaagagcaaa

SEQ ID NO: 9084 - DNA, 124 bp, Homo sapiens
atgcgcgccgtggccctgcgcgckggctggcagcagcgcaggcgctcggagaagaaaatcaccaggctgccttgatgccaccgtcaaccacgtgtcccttatccttagctatgccaacagctgc

SEQ ID NO: 9085 - DNA, 201 bp, Homo sapiens
ctgcgccaaccccattctctatggcttcctctccgacaacttccgccgattcttccagcgggttctctgcctgcgctgctgcctcctggaaggtgctggargtgctgaggaggagcccctggactactatgccactgctctcaagagcaaagtgtggcttgtggtagaatgcagtcagttcaggctctgtggccacctgct

SEQ ID NO: 9086 - DNA, 123 bp, Homo sapiens
atgcgcgccgtggccctgcgcgmtggctggcagcagcgcaggcgctcggagaagaaaatcaccaggctgccttgatgccaccgtcaaccacgtgtcccttatccttagctatgccaacagctg

SEQ ID NO: 9087 - DNA, 201 bp, Homo sapiens
gcgcgctggctggcagcagcgcaggcgctcggagaagaaaatcaccaggctgccttgatgccaccgtcaaccacgtgtcccttatccttagctatgccaayagctgcgccaaccccattctctatggcttcctctccgacaacttccgccgattcttccagcgggttctctgcctgcgctgctgcctcctggaaggtgctg

SEQ ID NO: 9088 - DNA, 119 bp, Homo sapiens
atgcgcgccgtggccctgygcgctggctggcagcagcgcaggcgctcggagaagaaaatcaccaggctgccttgatgccaccgtcaaccacgtgtcccttatccttagctatgccaaca

SEQ ID NO: 9089 - DNA, 201 bp, Homo sapiens
gcagcgcaggcgctcggagaagaaaatcaccaggctgccttgatgccaccgtcaaccacgtgtcccttatccttagctatgccaacagctgcgccaacccyattctctatggcttcctctccgacaacttccgccgattcttccagcgggttctctgcctgcgctgctgcctcctggaaggtgctggaggtgctgaggagg

SEQ ID NO: 9090 - DNA, 201 bp, Homo sapiens
cgccgtggccctgcgcgctggctggcagcagcgcaggcgctcggagaagaaaatcaccaggctgccttgatgccaccgtcaaccacgtgtcccttatcctyagctatgccaacagctgcgccaaccccattctctatggcttcctctccgacaacttccgccgattcttccagcgggttctctgcctgcgctgctgcctcc

SEQ ID NO: 9091 - DNA, 201 bp, Homo sapiens
gtcaaccacgtgtcccttatccttagctatgccaacagctgcgccaaccccattctctatggcttcctctccgacaacttccgccgattcttccagcgggytctctgcctgcgctgctgcctcctggaaggtgctggaggtgctgaggaggagcccctggactactatgccactgctctcaagagcaaaggtggggcaggg

SEQ ID NO: 9092 - DNA, 201 bp, Homo sapiens
agctgctgaacctcttcgtgaccagccttgatgccaccgtcaaccacgtgtcccttatccttagctatgccaacagctgcgccaaccccattctctatggyttcctctccgacaacttccgccgattcttccagcgggttctctgcctgcgctgctgcctcctggaaggtgctggaggtgctgaggaggagcccctggact

SEQ ID NO: 9093 - DNA, 201 bp, Homo sapiens; identical to SEQ ID NO: 9083

SEQ ID NO: 9094 - DNA, 201 bp, Homo sapiens
tgccaggatgggcactgatgaatatggttgaacggaactccaaggaccacccaggttgatagtagtgagtttgtgtacagaagactgcaatgaattgaagycatgagacatacagccaggatcctgaaagccaccaacatatgtcacctgcctgggaggcttgcttcgatggtcatcttgttctgcctgctaagaccagga

SEQ ID NO: 9095 - DNA, 201 bp, Homo sapiens
atccagtgcatctacgcgctggtgtgcctggtggggctggtgggcaacgccctggtcatcttcgtgatccttcgctacgccaagatgaagacggctaccamcatctacctgctcaacctggccgtagccgacgagctcttcatgctgagcgtgcccttcgtggcctcgtcggccgccctgcgccactggcccttcggctcc

SEQ ID NO: 9096 - DNA, 201 bp, Homo sapiens
tggtctacactttcctgctgggcttcctgctgcccgtgctggccattggcctgtgctacctgctcatcgtgggcaagatgcgcgccgtggccctgcgcgckggctggcagcagcgcaggcgctcggagaagaaaatcaccaggctggtgctgatggtcgtggtcgtctttgtgctctgctggatgcctttctacgtggtgc

SEQ ID NO: 9097 - DNA, 201 bp, Homo sapiens
ctgcgccaaccccattctctatggcttcctctccgacaacttccgccgattcttccagcgggttctctgcctgcgctgctgcctcctggaaggtgctggargtgctgaggaggagcccctggactactatgccactgctctcaagagcaaaggtggggcagggtgcatgtgccccccactcccctgccagcaggaagccct

SEQ ID NO: 9098 - DNA, 201 bp, Homo sapiens
gtggtctacactttcctgctgggcttcctgctgcccgtgctggccattggcctgtgctacctgctcatcgtgggcaagatgcgcgccgtggccctgcgcgmtggctggcagcagcgcaggcgctcggagaagaaaatcaccaggctggtgctgatggtcgtggtcgtctttgtgctctgctggatgcctttctacgtggtg

SEQ ID NO: 9099 - DNA, 201 bp, Homo sapiens
tctgctggatgcctttctacgtggtgcagctgctgaacctcttcgtgaccagccttgatgccaccgtcaaccacgtgtcccttatccttagctatgccaayagctgcgccaaccccattctctatggcttcctctccgacaacttccgccgattcttccagcgggttctctgcctgcgctgctgcctcctggaaggtgctg

SEQ ID NO: 9100 - DNA, 201 bp, Homo sapiens
tctacgtggtgcagctgctgaacctcttcgtgaccagccttgatgccaccgtcaaccacgtgtcccttatccttagctatgccaacagctgcgccaacccyattctctatggcttcctctccgacaacttccgccgattcttccagcgggttctctgcctgcgctgctgcctcctggaaggtgctggaggtgctgaggagg

SEQ ID NO: 9101 - DNA, 201 bp, Homo sapiens
cttcgtggtctacactttcctgctgggcttcctgctgcccgtgctggccattggcctgtgctacctgctcatcgtgggcaagatgcgcgccgtggccctgygcgctggctggcagcagcgcaggcgctcggagaagaaaatcaccaggctggtgctgatggtcgtggtcgtctttgtgctctgctggatgcctttctacgt

SEQ ID NO: 9102 - DNA, 201 bp, Homo sapiens
ccgtggcctgcaacctgcagtggccacacccggcctggtcggcagtcttcgtggtctacactttcctgctgggcttcctgctgcccgtgctggccattggyctgtgctacctgctcatcgtgggcaagatgcgcgccgtggccctgcgcgctggctggcagcagcgcaggcgctcggagaagaaaatcaccaggctggtgc

SEQ ID NO: 9103 - DNA, 201 bp, Homo sapiens
tcgtctttgtgctctgctggatgcctttctacgtggtgcagctgctgaacctcttcgtgaccagccttgatgccaccgtcaaccacgtgtcccttatcctyagctatgccaacagctgcgccaaccccattctctatggcttcctctccgacaacttccgccgattcttccagcgggttctctgcctgcgctgctgcctcc

SEQ ID NO: 9104 - DNA, 201 bp, Homo sapiens
caggcgctcggagaagaaaatcaccaggctggtgctgatggtcgtggtcgtctttgtgctctgctggatgcctttctacgtggtgcagctgctgaacctcktcgtgaccagccttgatgccaccgtcaaccacgtgtcccttatccttagctatgccaacagctgcgccaaccccattctctatggcttcctctccgacaa

SEQ ID NO: 9105 - DNA, 201 bp, Homo sapiens
tcactctccccatcgccatcttcgcagacaccagaccggctcgcggcggccaggccgtggcctgcaacctgcagtggccacacccggcctggtcggcagtyttcgtggtctacactttcctgctgggcttcctgctgcccgtgctggccattggcctgtgctacctgctcatcgtgggcaagatgcgcgccgtggccctgc

SEQ ID NO: 9106 - DNA, 201 bp, Homo sapiens; identical to SEQ ID NO: 9091

SEQ ID NO: 9107 - DNA, 201 bp, Homo sapiens; identical to SEQ ID NO: 9092

SEQ ID NO: 9108 - DNA, 201 bp, Homo sapiens; identical to SEQ ID NO: 9083

SEQ ID NO: 9109 - DNA, 201 bp, Homo sapiens; identical to SEQ ID NO: 9095

SEQ ID NO: 9110 - DNA, 201 bp, Homo sapiens; identical to SEQ ID NO: 9096

SEQ ID NO: 9111 - DNA, 201 bp, Homo sapiens; identical to SEQ ID NO: 9097

SEQ ID NO: 9112 - DNA, 201 bp, Homo sapiens; identical to SEQ ID NO: 9098

SEQ ID NO: 9113 - DNA, 201 bp, Homo sapiens; identical to SEQ ID NO: 9099

SEQ ID NO: 9114 - DNA, 201 bp, Homo sapiens; identical to SEQ ID NO: 9100

SEQ ID NO: 9115 - DNA, 201 bp, Homo sapiens; identical to SEQ ID NO: 9101

SEQ ID NO: 9116 - DNA, 201 bp, Homo sapiens; identical to SEQ ID NO: 9102

SEQ ID NO: 9117 - DNA, 201 bp, Homo sapiens; identical to SEQ ID NO: 9103

SEQ ID NO: 9118 - DNA, 201 bp, Homo sapiens; identical to SEQ ID NO: 9104

SEQ ID NO: 9119 - DNA, 201 bp, Homo sapiens; identical to SEQ ID NO: 9105

SEQ ID NO: 9120 - DNA, 201 bp, Homo sapiens
gccaatgtggtgagaaagtttggtgtcaccgacttcccctcttgctacctgctgttccggaatggctctgtctcccgagtccccgtgctcatggaatccakgtccttctataccgcttacctgcagagactctctgggctcaccagggaggctgcccagaccacagttgcaccaaccactgctaacaagatagctcccact

SEQ ID NO: 9121 - DNA, 201 bp, Homo sapiens
tccagccttgaagagaatggactctggaatctgacgtctgggtttgaatccagcttccaacactcactggctgtgtgactttgggcaagataacttatccycttgtccccatgtgtcattggagataaactacccacctaccagattgttgtaccatgctgggcaaacactaagtgcttaataatggtagcccactgctca

SEQ ID NO: 9122 - DNA, 201 bp, Homo sapiens
tctcctgtcttgatacctgaaaactcaaggggccctgttgtgcttggaggggggtgccgttcccacaggatattctgtgaagggtgtccctggagctgggyctccaggtggcaagccccaagccaccccggcaggtgccactggccagagttgaactgaggtgttgagtggaaagtgcctccccacccccatctgccacag

SEQ ID NO: 9123 - DNA, 201 bp, Homo sapiens
ccactggagcctgccaagctggaggagattgatggattctttgcgagaaataacgaagagtacctggctctgatctttgaaaagggaggctcctacctggstagagaggtggctctggacctgtcccagcacaaaggcgtggcggtgcgcagggtgctgaacacagaggccaatgtggtgagaaagtttggtgtcaccgac

SEQ ID NO: 9124 - DNA, 201 bp, Homo sapiens
tgactttgggcaagataacttatccccttgtccccatgtgtcattggagataaactacccacctaccagattgttgtaccatgctgggcaaacactaagtrcttaataatggtagcccactgctcatgtcgtgtcgtctcctgtcttgatacctgaaaactcaaggggccctgttgtgcttggaggggggtgccgttccca

SEQ ID NO: 9125 - DNA, 201 bp, Homo sapiens
ttccacttcttgactgtgcaggcagctcggcaaaatgtagaccactcacaggaagcagccaaggccaaggaggtcctcccagccatccgaggctacgtgcrctacttcttcggctgccgagactgcgctagccacttcgagcagatggctgctgcctccatgcaccgggtggggagtcccaacgccgctgtcctctggctc

SEQ ID NO: 9126 - DNA, 201 bp, Homo sapiens
gagtggcttgcttggtgggacctgacgagttggtggcatgggaaggatgtgggtctctagtgccttgccctggcttagctgcaggagaagatggctgcttycacttccccccattgagctctgctccctctgagcctggtcttttgtccttttttattttggtctccaagatgaatgctcatctttggagggtgccaggta

SEQ ID NO: 9127 - DNA, 201 bp, Homo sapiens
tgtggcagccgccccagagctggcgatgggagccctggagctggaaagccggaattcaactctggaccctgggaagcctgagatgatgaagtcccccacamacaccaccccacatgtgccggctgagggacctgagcttatttgaagtcctgcctcattctcactggagcctcagtctctcctgcttggtcttggccctca

SEQ ID NO: 9128 - DNA, 201 bp, Homo sapiens
ttggtggcatgggaaggatgtgggtctctagtgccttgccctggcttagctgcaggagaagatggctgctttcacttccccccattgagctctgctccctytgagcctggtcttttgtccttttttattttggtctccaagatgaatgctcatctttggagggtgccaggtagaagctagggaggggagtgtcttctctct

SEQ ID NO: 9129 - DNA, 201 bp, Homo sapiens
cacttccccccattgagctctgctccctctgagcctggtcttttgtccttttttattttggtctccaagatgaatgctcatctttggagggtgccaggtaraagctagggaggggagtgtcttctctctccaggtttcaccttccagtgtgcagaagttagaagggtctggcgggggcagtgccttacacatgcttgattc

SEQ ID NO: 9130 - DNA, 201 bp, Homo sapiens
tgtctgcacccaaaccccatggccttttcatgcacggagacaggcctctggatgtgcagccttgccaccccctgccccaatcctccctgagagctcctgcstcagtgccctgggctggtgagggagaagcctgtctgcacctgcctaattccagctcctccaggaagcaagggcttgtttgtcagagctgcagggttggcc

SEQ ID NO: 9131 - DNA, 201 bp, Homo sapiens
gtcttttgtccttttttattttggtctccaagatgaatgctcatctttggagggtgccaggtagaagctagggaggggagtgtcttctctctccaggtttyaccttccagtgtgcagaagttagaagggtctggcgggggcagtgccttacacatgcttgattcccacgctaccccctgccttgggaggtgtgtggaataa

SEQ ID NO: 9132 - DNA, 201 bp, Homo sapiens
tcttttgtccttttttattttggtctccaagatgaatgctcatctttggagggtgccaggtagaagctagggaggggagtgtcttctctctccaggtttcmccttccagtgtgcagaagttagaagggtctggcgggggcagtgccttacacatgcttgattcccacgctaccccctgccttgggaggtgtgtggaataaa

SEQ ID NO: 9133 - DNA, 201 bp, Homo sapiens
tattttggtctccaagatgaatgctcatctttggagggtgccaggtagaagctagggaggggagtgtcttctctctccaggtttcaccttccagtgtgcaraagttagaagggtctggcgggggcagtgccttacacatgcttgattcccacgctaccccctgccttgggaggtgtgtggaataaattatttttgttaagg

SEQ ID NO: 9134 - DNA, 201 bp, Homo sapiens
gtctccaagatgaatgctcatctttggagggtgccaggtagaagctagggaggggagtgtcttctctctccaggtttcaccttccagtgtgcagaagttaraagggtctggcgggggcagtgccttacacatgcttgattcccacgctaccccctgccttgggaggtgtgtggaataaattatttttgttaaggcaagcat

SEQ ID NO: 9135 - DNA, 201 bp, Homo sapiens
cagatggctgctgcctccatgcaccgggtggggagtcccaacgccgctgtcctctggctctggtctagccacaacagggtcaatgctcgccttgcaggtgmccccagcgaggacccccagttccccaaggtgcagtggccaccccgtgaactttgttctgcctgccacaatgaacgcctggatgtgcccgtgtgggacgtg

SEQ ID NO: 9136 - DNA, 201 bp, Homo sapiens
tcctccaggaagcaagggcttgtttgtcagagctgcagggttggccactcggtggggaggagtcagccaggattagagagcctgcccctaatccggcctgmtgggttttacaaggatcagagctgctgataatgaacctcattaagggggagcaggagcctcaatccgatttggttttctctttgacatcttcactctgct

SEQ ID NO: 9137 - DNA, 201 bp, Homo sapiens
cagcgaggacccccagttccccaaggtgcagtggccaccccgtgaactttgttctgcctgccacaatgaacgcctggatgtgcccgtgtgggacgtggaarccaccctcaacttcctcaaggcccacttctccccaagcaacatcatcctggacttccctgcagctgggtcagctgcccggagggatgtgcagaatgtggc

SEQ ID NO: 9138 - DNA, 201 bp, Homo sapiens
caactggggcaagtgaagccagaggagggtcccccagctgggtgggctggaatggaactcctcactagctgctggggctccgcccaccctgctcccttccrgacaatgaagaagcctttgcaccctgggaggaaggaccaccccgggccctctatgcctggccagcctccagctcctcagacctcctgggtggggtttggc

SEQ ID NO: 9139 - DNA, 201 bp, Homo sapiens
ttcttggaggtccaagaggggcagcgccaccttgggccaggctcctctccagcagccttggtatggggtgggggtgggaagacccctgatgcagcctgtcytctgggtgtgggggtggaggagagggctccaggggacccagccagccttgaccctggaggaaagtcaggtgggctcagagagagccctcaaatctgggcc

SEQ ID NO: 9140 - DNA, 201 bp, Homo sapiens
ctgggtttgaatccagcttccaacactcactggctgtgtgactttgggcaagataacttatccccttgtccccatgtgtcattggagataaactacccacytaccagattgttgtaccatgctgggcaaacactaagtgcttaataatggtagcccactgctcatgtcgtgtcgtctcctgtcttgatacctgaaaactca

SEQ ID NO: 9141 - DNA, 201 bp, Homo sapiens
ttcatgcacggagacaggcctctggatgtgcagccttgccaccccctgccccaatcctccctgagagctcctgcctcagtgccctgggctggtgagggagragcctgtctgcacctgcctaattccagctcctccaggaagcaagggcttgtttgtcagagctgcagggttggccactcggtggggaggagtcagccagga

SEQ ID NO: 9142 - DNA, 201 bp, Homo sapiens
tagaattagcgccatgttggaaacactgtcgcagcagcccgggctgcacagtgtgtagcccagcctccaggtccacggagtggtgtggacctcccacctcmcagctgcctctggcagccaagcctcttttcgcccggccccagcccctctggttgataaacgggtgggcctcctcagcagcgtggctgcctttcaccttga

SEQ ID NO: 9143 - DNA, 201 bp, Homo sapiens
gagagcctgcccctaatccggcctgctgggttttacaaggatcagagctgctgataatgaacctcattaagggggagcaggagcctcaatccgatttggtyttctctttgacatcttcactctgctcagatggcctgggtgctatgtggagcaggtgggatgccaaggccactcctgctatggggcagctggggctgggga

SEQ ID NO: 9144 - DNA, 201 bp, Homo sapiens
ccctcaacttcctcaaggcccacttctccccaagcaacatcatcctggacttccctgcagctgggtcagctgcccggagggatgtgcagaatgtggcagcmgccccagagctggcgatgggagccctggagctggaaagccggaattcaactctggaccctgggaagcctgagatgatgaagtcccccacaaacaccaccc

SEQ ID NO: 9145 - DNA, 201 bp, Homo sapiens
aaggcgctggccgaagacgtcaaagcctggaggccggccctgtatctcgccgccctggactgtgctgaggagaccaacagtgcagtctgcagagacttcarcatccctggcttcccgactgtgaggttcttcaaggcctttaccaagaacggctcgggagcagtatttccagtggctggtgctgacgtgcagacgctgcgg

SEQ ID NO: 9146 - DNA, 201 bp, Homo sapiens
tgcgggcggaggcaggcggtgccgcggcgccgggacccgactcatccggtgcttgcgtgtggtggtgagcgcagcgccgaggatgaggaggtgcaacagcsgctccgggccgccgccgtcgctgctgctgctgctgctgtggctgctcgcggttcccggcgctaacgcggccccgcggtcggcgctctattcgccttccga

SEQ ID NO: 9147 - DNA, 201 bp, Homo sapiens
acttcaacatccctggcttcccgactgtgaggttcttcaaggcctttaccaagaacggctcgggagcagtatttccagtggctggtgctgacgtgcagacrctgcgggagaggctcattgacgccctggagtcccatcatgacacgtggcccccagcctgtcccccactggagcctgccaagctggaggagattgatggat

SEQ ID NO: 9148 - DNA, 201 bp, Homo sapiens
aaattccctacagtttctttaaaactgccctggacgacaggaaagagggtgccgttcttgccaagaaggtgaactggattggctgccaggggagtgagccrcatttccggggctttccctgctccctgtgggtcctcttccacttcttgactgtgcaggcagctcggcaaaatgtagaccactcacaggaagcagccaagg

SEQ ID NO: 9149 - DNA, 201 bp, Homo sapiens
tggactgtgctgaggagaccaacagtgcagtctgcagagacttcaacatccctggcttcccgactgtgaggttcttcaaggcctttaccaagaacggctcrggagcagtatttccagtggctggtgctgacgtgcagacgctgcgggagaggctcattgacgccctggagtcccatcatgacacgtggcccccagcctgtc

SEQ ID NO: 9150 - DNA, 201 bp, Homo sapiens
gggtgctgaacacagaggccaatgtggtgagaaagtttggtgtcaccgacttcccctcttgctacctgctgttccggaatggctctgtctcccgagtcccygtgctcatggaatccaggtccttctataccgcttacctgcagagactctctgggctcaccagggaggctgcccagaccacagttgcaccaaccactgcta

SEQ ID NO: 9151 - DNA, 201 bp, Homo sapiens
acgacaggaaagagggtgccgttcttgccaagaaggtgaactggattggctgccaggggagtgagccgcatttccggggctttccctgctccctgtgggtyctcttccacttcttgactgtgcaggcagctcggcaaaatgtagaccactcacaggaagcagccaaggccaaggaggtcctcccagccatccgaggctacg

SEQ ID NO: 9152 - DNA, 201 bp, Homo sapiens
acaggaaagagggtgccgttcttgccaagaaggtgaactggattggctgccaggggagtgagccgcatttccggggctttccctgctccctgtgggtcctyttccacttcttgactgtgcaggcagctcggcaaaatgtagaccactcacaggaagcagccaaggccaaggaggtcctcccagccatccgaggctacgtgc

SEQ ID NO: 9153 - DNA, 201 bp, Homo sapiens
tcatctttggagggtgccaggtagaagctagggaggggagtgtcttctctctccaggtttcaccttccagtgtgcagaagttagaagggtctggcgggggyagtgccttacacatgcttgattcccacgctaccccctgccttgggaggtgtgtggaataaattatttttgttaaggcaagcattggtgtgttctttaact

SEQ ID NO: 9154 - DNA, 201 bp, Homo sapiens
gctagggaggggagtgtcttctctctccaggtttcaccttccagtgtgcagaagttagaagggtctggcgggggcagtgccttacacatgcttgattcccmcgctaccccctgccttgggaggtgtgtggaataaattatttttgttaaggcaagcattggtgtgttctttaacttgctacttggagacctagtgtccagt

SEQ ID NO: 9155 - DNA, 201 bp, Homo sapiens
cgcttacctgcagagactctctgggctcaccagggaggctgcccagaccacagttgcaccaaccactgctaacaagatagctcccactgtttggaaattgkcagatcgctccaagatctacatggctgacctggaatctgcactgcactacatcctgcggatagaagtgggcaggttcccggtcctggaagggcagcgcct

SEQ ID NO: 9156 - DNA, 201 bp, Homo sapiens; identical to SEQ ID NO: 9120

SEQ ID NO: 9157 - DNA, 201 bp, Homo sapiens; identical to SEQ ID NO: 9121

SEQ ID NO: 9158 - DNA, 201 bp, Homo sapiens; identical to SEQ ID NO: 9122

SEQ ID NO: 9159 - DNA, 201 bp, Homo sapiens; identical to SEQ ID NO: 9123

SEQ ID NO: 9160 - DNA, 201 bp, Homo sapiens; identical to SEQ ID NO: 9124

SEQ ID NO: 9161 - DNA, 201 bp, Homo sapiens; identical to SEQ ID NO: 9125

SEQ ID NO: 9162 - DNA, 201 bp, Homo sapiens; identical to SEQ ID NO: 9126

SEQ ID NO: 9163 - DNA, 201 bp, Homo sapiens
tgtggcagccgccccagagctggcgatgggagccctggagctggaaagccggaattcaactctggaccctgggaagcctgagatgatgaagtcccccacamacaccaccccacatgtgccggctgagggacctgaggcaagtcgacccccgaagctgcaccctggcctcagagctgcaccaggccaggagcctcctgagca

SEQ ID NO: 9164 - DNA, 201 bp, Homo sapiens; identical to SEQ ID NO: 9128

SEQ ID NO: 9165 - DNA, 201 bp, Homo sapiens; identical to SEQ ID NO: 9129

SEQ ID NO: 9166 - DNA, 201 bp, Homo sapiens; identical to SEQ ID NO: 9130

SEQ ID NO: 9167 - DNA, 201 bp, Homo sapiens; identical to SEQ ID NO: 9131

SEQ ID NO: 9168 - DNA, 201 bp, Homo sapiens; identical to SEQ ID NO: 9132

SEQ ID NO: 9169 - DNA, 201 bp, Homo sapiens; identical to SEQ ID NO: 9133

SEQ ID NO: 9170 - DNA, 201 bp, Homo sapiens; identical to SEQ ID NO: 9134

SEQ ID NO: 9171 - DNA, 201 bp, Homo sapiens; identical to SEQ ID NO: 9135

SEQ ID NO: 9172 - DNA, 201 bp, Homo sapiens; identical to SEQ ID NO: 9136

SEQ ID NO: 9173 - DNA, 201 bp, Homo sapiens; identical to SEQ ID NO: 9137

SEQ ID NO: 9174 - DNA, 201 bp, Homo sapiens; identical to SEQ ID NO: 9138

SEQ ID NO: 9175 - DNA, 201 bp, Homo sapiens; identical to SEQ ID NO: 9139

SEQ ID NO: 9176 - DNA, 201 bp, Homo sapiens; identical to SEQ ID NO: 9140

SEQ ID NO: 9177 - DNA, 201 bp, Homo sapiens; identical to SEQ ID NO: 9141

SEQ ID NO: 9178 - DNA, 201 bp, Homo sapiens; identical to SEQ ID NO: 9142

SEQ ID NO: 9179 - DNA, 201 bp, Homo sapiens; identical to SEQ ID NO: 9143

SEQ ID NO: 9180 - DNA, 201 bp, Homo sapiens
ggcacttgagcaagcgagacacaggggctgcattgctggctgagtccagggctgagaagaaccgcctctggggccctttggaggtcaggcgcgtgggccgmagctccaagcagctggtcgacatccctgagggccagctggaggcccgagctggacggggccgaggccagtggctgcaggtgctgggagggggcttctctt

SEQ ID NO: 9181 - DNA, 201 bp, Homo sapiens; identical to SEQ ID NO: 9144

SEQ ID NO: 9182 - DNA, 201 bp, Homo sapiens; identical to SEQ ID NO: 9145

SEQ ID NO: 9183 - DNA, 201 bp, Homo sapiens; identical to SEQ ID NO: 9146

SEQ ID NO: 9184 - DNA, 201 bp, Homo sapiens; identical to SEQ ID NO: 9147

SEQ ID NO: 9185 - DNA, 201 bp, Homo sapiens; identical to SEQ ID NO: 9148

SEQ ID NO: 9186 - DNA, 201 bp, Homo sapiens; identical to SEQ ID NO: 9149

SEQ ID NO: 9187 - DNA, 201 bp, Homo sapiens; identical to SEQ ID NO: 9150

SEQ ID NO: 9188 - DNA, 201 bp, Homo sapiens; identical to SEQ ID NO: 9151

SEQ ID NO: 9189 - DNA, 201 bp, Homo sapiens; identical to SEQ ID NO: 9152

SEQ ID NO: 9190 - DNA, 201 bp, Homo sapiens; identical to SEQ ID NO: 9153

SEQ ID NO: 9191 - DNA, 201 bp, Homo sapiens; identical to SEQ ID NO: 9154

SEQ ID NO: 9192 - DNA, 201 bp, Homo sapiens; identical to SEQ ID NO: 9155

SEQ ID NO: 9193 - DNA, 201 bp, Homo sapiens
tttattggagtaatctagaaaattttaaaattgttacatctttggtatttataaatgtgatactttactttctgtgggtacttctatagaggcactacagratcagaaaatgcaaattgaatcattttagcaccttttgatataaatagaaatgcactgatgcagaggtaaaaaatcttagaacttttgttgggaaactat

SEQ ID NO: 9194 - DNA, 201 bp, Homo sapiens
tctggcatgtttggaaatcaaaatgtcacattctcgggggaggaagcccagaaaattgggtatgttctagagatttaccaccattgcttattgcttttttytttaataaagtttaggaaagtagaatttttattatgtactgtatgtttgcataaatcacctttctcctttgtggttaaggcatatatgccaacccccagc

SEQ ID NO: 9195 - DNA, 201 bp, Homo sapiens
cttggccagaaggaatccatggcaaaaatcaggtttagagtcttaaactctaattcttagttgaatgaatttgatcttttaaatattaatgataaatgttwacaagaagttgctttaataagcaacagttaaaattctgttacctttttaaacttgcaataacaaccttcatttttaaaaatacagtagtaaagattgagg

SEQ ID NO: 9196 - DNA, 201 bp, Homo sapiens
tgggaaactataaataattggtcctttcccatcagttctgcattggcttctccaactgtcaaggtttaggattatattgttatattgatcacatgtgcttwaatttcttggccagaaggaatccatggcaaaaatcaggtttagagtcttaaactctaattcttagttgaatgaatttgatcttttaaatattaatgataa

SEQ ID NO: 9197 - DNA, 201 bp, Homo sapiens
agaaggaatccatggcaaaaatcaggtttagagtcttaaactctaattcttagttgaatgaatttgatcttttaaatattaatgataaatgtttacaagawgttgctttaataagcaacagttaaaattctgttacctttttaaacttgcaataacaaccttcatttttaaaaatacagtagtaaagattgaggtatcagc

SEQ ID NO: 9198 - DNA, 201 bp, Homo sapiens
atcgacaagaagctattgactggcttcttggtttagctgttagacttgaatatggagataatgctgaaaaatacaaggatttagtacctgataattcaaaractgctgacaatgcaactaaaaatgcagaaccattgatcaatttggatgtaaataatcctgattttaaggctggtgtgatggctttggctaacctgcttc

SEQ ID NO: 9199 - DNA, 201 bp, Homo sapiens
ggtaaaaaatcttagaacttttgttgggaaactataaataattggtcctttcccatcagttctgcattggcttctccaactgtcaaggtttaggattatawtgttatattgatcacatgtgctttaatttcttggccagaaggaatccatggcaaaaatcaggtttagagtcttaaactctaattcttagttgaatgaatt

SEQ ID NO: 9200 - DNA, 201 bp, Homo sapiens
aagaagctattgactggcttcttggtttagctgttagacttgaatatggagataatgctgaaaaatacaaggatttagtacctgataattcaaaaactgcwgacaatgcaactaaaaatgcagaaccattgatcaatttggatgtaaataatcctgattttaaggctggtgtgatggctttggctaacctgcttcagattc

SEQ ID NO: 9201 - DNA, 201 bp, Homo sapiens
tttaagaaacatccacagcagcgactggcccaagttctttgaaaagtatctcagagatgttaactgtcctttcaagattcaagatcgacaagaagctattsactggcttcttggtttagctgttagacttgaatatggagataatgctgaaaaatacaaggatttagtacctgataattcaaaaactgctgacaatgcaac

SEQ ID NO: 9202 - DNA, 201 bp, Homo sapiens
ccagaaaatcaggcactacaagattgaagacagagggaatttaagaaacatccacagcagcgactggcccaagttctttgaaaagtatctcagagatgttmactgtcctttcaagattcaagatcgacaagaagctattgactggcttcttggtttagctgttagacttgaatatggagataatgctgaaaaatacaagga

SEQ ID NO: 9203 - DNA, 201 bp, Homo sapiens
ctgcccgccgttctgctcgctcgctccccgctctggagtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcac

SEQ ID NO: 9204 - DNA, 201 bp, Homo sapiens
ggccctgtactgtggtcaaagtcaaggcctccgggcaggactcgcggcccctccggctggcgggtggggttgacccgcacgtcccgccccgcctctccctycgcgctccggacgggcgacggtagctcgagacccgggactccgcccgcctccccgcgagtatttgaggtccggggcggctccggcgcctctgcccgccgt

SEQ ID NO: 9205 - DNA, 201 bp, Homo sapiens
gcctcccagtgttgggattactggcgtgagccccgcgcccgcccctggctggcttctttgccgcaagctgtttcatcagcaaagtctttgtgacctgtatytagtctgctcatttttaaatgcgtgttctgcactccccagtggatggccgtgtatcaggagccggcccttttctggaaacaggccagcattcagtctcca

SEQ ID NO: 9206 - DNA, 201 bp, Homo sapiens
tcatgatgatgcggtgtgccagattcgtcccccgcttctgcgccgaccaccccttccttttcttcatccagcacagcaagaccaacgggattctcttctgyggccgcttttcctctccgtgaggacagggcagtcttggtgtgcagcccctctcctctctgtcccctgacactccacagtgtgcctgcaacccaagtggcc

SEQ ID NO: 9207 - DNA, 201 bp, Homo sapiens
actttctttcaataaaagtggcggtggtggagacatccaccagggcttccagtctcttctcaccgaagtgaacaagactggcacgcagtacttgcttaggrtggccaacaggctctttggggaaaagtcttgtgatttcctctcatcttttagagattcctgccaaaaattctaccaagcagagatggaggagcttgactt

SEQ ID NO: 9208 - DNA, 201 bp, Homo sapiens
gaaacaccgctgcacagatggcccagatactttctttcaataaaagtggcggtggtggagacatccaccagggcttccagtctcttctcaccgaagtgaayaagactggcacgcagtacttgcttaggatggccaacaggctctttggggaaaagtcttgtgatttcctctcatcttttagagattcctgccaaaaattct

SEQ ID NO: 9209 - DNA, 201 bp, Homo sapiens
aaatcttggtgcttccatatgttggcaaggaactgaatatgatcatcatgcttccggacgagaccactgacttgagaacggtggagaaagaactcacttaygagaagttcgtagaatggacgaggctggacatgatggatgaagaggaggtggaagtgtccctcccgcggtttaaactagaggaaagctacgacatggaga

SEQ ID NO: 9210 - DNA, 201 bp, Homo sapiens
gtccaaggtcgtgcacaagtcttttgtggaggtcaatgaggaaggcacggaggctgcagccgccacagctgccatcatgatgatgcggtgtgccagattcrtcccccgcttctgcgccgaccaccccttccttttcttcatccagcacagcaagaccaacgggattctcttctgcggccgcttttcctctccgtgaggaca

SEQ ID NO: 9211 - DNA, 201 bp, Homo sapiens
ggagcttgactttatcagcgccgtagagaagtccagaaaacacataaacacctgggtagctgaaaagacagaaggtaaaattgcggagttgctctctccgrgctcagtggatccattgacaaggctggttctggtgaatgctgtctatttcagaggaaactgggatgaacagtttgacaaggagaacaccgaggagagact

SEQ ID NO: 9212 - DNA, 124 bp, Homo sapiens
tcactgcagcctctgcctcccggrttcaagtgattctcctgcctcagcttccccagcaactgagattacaggcacgcgccattacactcggctaatttttgtatttttagtagagacggggttt

SEQ ID NO: 9213 - DNA, 201 bp, Homo sapiens
cagaggaaactgggatgaacagtttgacaaggagaacaccgaggagagactgtttaaagtcagcaaggcgaaatgaggagaaacctgtgcaaatgatgttkaagcaatctacttttaagaagacctatataggagaaatatttacccaaatcttggtgcttccatatgttggcaaggaactgaatatgatcatcatgcttc

SEQ ID NO: 9214 - DNA, 201 bp, Homo sapiens
gcctcccgggttcaagtgattctcctgcctcagcttccccagcaactgagattacaggcacgcgccattacactcggctaatttttgtatttttagtagaracggggttttgccatgttggccaggctggtctggaactcctgacctccagtgatccgcctgcctcggcctcccagtgttgggattactggcgtgagcccc

SEQ ID NO: 9215 - DNA, 201 bp, Homo sapiens
ctgcctcccgggttcaagtgattctcctgcctcagcttccccagcaactgagattacaggcacgcgccattacactcggctaatttttgtatttttagtaragacggggttttgccatgttggccaggctggtctggaactcctgacctccagtgatccgcctgcctcggcctcccagtgttgggattactggcgtgagcc

SEQ ID NO: 9216 - DNA, 164 bp, Homo sapiens
tcactgcagcctctgcctcccgggttcaagtgattctcctgcctcagcttccccagcaactgarattacaggcacgcgccattacactcggctaatttttgtatttttagtagagacggggttttgccatgttggccaggctggtctggaactcctgacctcca

SEQ ID NO: 9217 - DNA, 146 bp, Homo sapiens
tcactgcagcctctgcctcccgggttcaagtgattctcctgcctcwgcttccccagcaactgagattacaggcacgcgccattacactcggctaatttttgtatttttagtagagacggggttttgccatgttggccaggctggtc

SEQ ID NO: 9218 - DNA, 201 bp, Homo sapiens
gcgggatgggggcggcgcagagcctcccgggccacaggtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcac

SEQ ID NO: 9219 - DNA, 201 bp, Homo sapiens; identical to SEQ ID NO: 9204

SEQ ID NO: 9220 - DNA, 201 bp, Homo sapiens; identical to SEQ ID NO: 9205

SEQ ID NO: 9221 - DNA, 201 bp, Homo sapiens; identical to SEQ ID NO: 9207

SEQ ID NO: 9222 - DNA, 201 bp, Homo sapiens; identical to SEQ ID NO: 9208

SEQ ID NO: 9223 - DNA, 201 bp, Homo sapiens; identical to SEQ ID NO: 9209

SEQ ID NO: 9224 - DNA, 201 bp, Homo sapiens; identical to SEQ ID NO: 9210

SEQ ID NO: 9225 - DNA, 124 bp, Homo sapiens; identical to SEQ ID NO: 9212

SEQ ID NO: 9226 - DNA, 201 bp, Homo sapiens; identical to SEQ ID NO: 9213

SEQ ID NO: 9227 - DNA, 201 bp, Homo sapiens
gggtcgcgcggggccgggaacgcgcgtgggtcgacggcgcgcggggacgctggagccccgagaatggggcgtggccgcgcggggctgtgaccccagcagtmccagcggggcgggggcccgggcgagcgtccggcttgggttcccttccggagcctcgcagcggcagagaacggcgacgcggccgggtgagtcgtgcgtggc

SEQ ID NO: 9228 - DNA, 201 bp, Homo sapiens; identical to SEQ ID NO: 9206

SEQ ID NO: 9229 - DNA, 201 bp, Homo sapiens; identical to SEQ ID NO: 9211

SEQ ID NO: 9230 - DNA, 201 bp, Homo sapiens; identical to SEQ ID NO: 9214

SEQ ID NO: 9231 - DNA, 201 bp, Homo sapiens; identical to SEQ ID NO: 9215

SEQ ID NO: 9232 - DNA, 201 bp, Homo sapiens
gagcggggaggggggcagggtgggggtcgcgcggggccgggaacgcgcgtgggtcgacggcgcgcggggacgctggagccccgagaatggggcgtggccgygcggggctgtgaccccagcagtcccagcggggcgggggcccgggcgagcgtccggcttgggttcccttccggagcctcgcagcggcagagaacggcgacg

SEQ ID NO: 9233 - DNA, 164 bp, Homo sapiens; identical to SEQ ID NO: 9216

SEQ ID NO: 9234 - DNA, 146 bp, Homo sapiens; identical to SEQ ID NO: 9217

SEQ ID NO: 9235 - DNA, 201 bp, Homo sapiens; identical to SEQ ID NO: 9203

SEQ ID NO: 9236 - DNA, 201 bp, Homo sapiens; identical to SEQ ID NO: 9204

SEQ ID NO: 9237 - DNA, 201 bp, Homo sapiens; identical to SEQ ID NO: 9205

SEQ ID NO: 9238 - DNA, 201 bp, Homo sapiens; identical to SEQ ID NO: 9206

SEQ ID NO: 9239 - DNA, 201 bp, Homo sapiens; identical to SEQ ID NO: 9207

SEQ ID NO: 9240 - DNA, 201 bp, Homo sapiens; identical to SEQ ID NO: 9208

SEQ ID NO: 9241 - DNA, 201 bp, Homo sapiens; identical to SEQ ID NO: 9209

SEQ ID NO: 9242 - DNA, 201 bp, Homo sapiens; identical to SEQ ID NO: 9211

SEQ ID NO: 9243 - DNA, 201 bp, Homo sapiens; identical to SEQ ID NO: 9210

SEQ ID NO: 9244 - DNA, 124 bp, Homo sapiens; identical to SEQ ID NO: 9212

SEQ ID NO: 9245 - DNA, 201 bp, Homo sapiens
atttcagaggaaactgggatgaacagtttgacaaggagaacaccgaggagagactgtttaaagtcagcaagaatgaggagaaacctgtgcaaatgatgttkaagcaatctacttttaagaagacctatataggagaaatatttacccaaatcttggtgcttccatatgttggcaaggaactgaatatgatcatcatgcttc

SEQ ID NO: 9246 - DNA, 201 bp, Homo sapiens; identical to SEQ ID NO: 9214

SEQ ID NO: 9247 - DNA, 201 bp, Homo sapiens; identical to SEQ ID NO: 9215

SEQ ID NO: 9248 - DNA, 164 bp, Homo sapiens; identical to SEQ ID NO: 9216

SEQ ID NO: 9249 - DNA, 146 bp, Homo sapiens; identical to SEQ ID NO: 9217

SEQ ID NO: 9250 - DNA, 201 bp, Homo sapiens
tgtctggcttgggagccgctcggacacgctggcttgggtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcac

SEQ ID NO: 9251 - DNA, 201 bp, Homo sapiens; identical to SEQ ID NO: 9204

SEQ ID NO: 9252 - DNA, 201 bp, Homo sapiens; identical to SEQ ID NO: 9205

SEQ ID NO: 9253 - DNA, 201 bp, Homo sapiens; identical to SEQ ID NO: 9206

SEQ ID NO: 9254 - DNA, 201 bp, Homo sapiens; identical to SEQ ID NO: 9207

SEQ ID NO: 9255 - DNA, 201 bp, Homo sapiens; identical to SEQ ID NO: 9208

SEQ ID NO: 9256 - DNA, 201 bp, Homo sapiens; identical to SEQ ID NO: 9209

SEQ ID NO: 9257 - DNA, 201 bp, Homo sapiens; identical to SEQ ID NO: 9210

SEQ ID NO: 9258 - DNA, 201 bp, Homo sapiens; identical to SEQ ID NO: 9211

SEQ ID NO: 9259 - DNA, 124 bp, Homo sapiens; identical to SEQ ID NO: 9212

SEQ ID NO: 9260 - DNA, 201 bp, Homo sapiens; identical to SEQ ID NO: 9213

SEQ ID NO: 9261 - DNA, 201 bp, Homo sapiens; identical to SEQ ID NO: 9214

SEQ ID NO: 9262 - DNA, 201 bp, Homo sapiens; identical to SEQ ID NO: 9215

SEQ ID NO: 9263 - DNA, 164 bp, Homo sapiens; identical to SEQ ID NO: 9216

SEQ ID NO: 9264 - DNA, 146 bp, Homo sapiens; identical to SEQ ID NO: 9217

SEQ ID NO: 9265 - DNA, 201 bp, Homo sapiens
tgacatgtcctgtccatgtaaacagaacttcctccatgtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcac

SEQ ID NO: 9266 - DNA, 201 bp, Homo sapiens
tttatgattaattgttcagtgtttatgcattattgcgaagtgataatgaaaatgctcaaactcagggtcctgcaggcactgtgggggaggcagtggggacstgaggggattacagatccagtagaagccccccgacccccatctgcttccaccccatctccttccagaacaccaccgatagccacaccgaagagttctccc

SEQ ID NO: 9267 - DNA, 201 bp, Homo sapiens; identical to SEQ ID NO: 9206

SEQ ID NO: 9268 - DNA, 201 bp, Homo sapiens; identical to SEQ ID NO: 9207

SEQ ID NO: 9269 - DNA, 201 bp, Homo sapiens
caccaccgatagccacaccgaagagttctcccatttgctggttcccggacaaaaaagctgctgatcccttgagcacactgcagtgaagctcccagctgacrtgtcctgtccatgtaaacagaacttcctccatgtctgccatcatggatgttctcgcagaagcaaatggcacctttgccttaaaccttttgaaaacgctgg

SEQ ID NO: 9270 - DNA, 201 bp, Homo sapiens; identical to SEQ ID NO: 9208

SEQ ID NO: 9271 - DNA, 201 bp, Homo sapiens; identical to SEQ ID NO: 9209

SEQ ID NO: 9272 - DNA, 201 bp, Homo sapiens; identical to SEQ ID NO: 9211

SEQ ID NO: 9273 - DNA, 201 bp, Homo sapiens; identical to SEQ ID NO: 9210

SEQ ID NO: 9274 - DNA, 201 bp, Homo sapiens; identical to SEQ ID NO: 9245

SEQ ID NO: 9275 - DNA, 201 bp, Homo sapiens; identical to SEQ ID NO: 9218

SEQ ID NO: 9276 - DNA, 201 bp, Homo sapiens; identical to SEQ ID NO: 9204

SEQ ID NO: 9277 - DNA, 201 bp, Homo sapiens; identical to SEQ ID NO: 9205

SEQ ID NO: 9278 - DNA, 201 bp, Homo sapiens; identical to SEQ ID NO: 9207

SEQ ID NO: 9279 - DNA, 201 bp, Homo sapiens; identical to SEQ ID NO: 9208

SEQ ID NO: 9280 - DNA, 201 bp, Homo sapiens; identical to SEQ ID NO: 9209

SEQ ID NO: 9281 - DNA, 201 bp, Homo sapiens; identical to SEQ ID NO: 9210

SEQ ID NO: 9282 - DNA, 124 bp, Homo sapiens; identical to SEQ ID NO: 9212

SEQ ID NO: 9283 - DNA, 201 bp, Homo sapiens; identical to SEQ ID NO: 9245

SEQ ID NO: 9284 - DNA, 201 bp, Homo sapiens; identical to SEQ ID NO: 9227

SEQ ID NO: 9285 - DNA, 201 bp, Homo sapiens; identical to SEQ ID NO: 9206

SEQ ID NO: 9286 - DNA, 201 bp, Homo sapiens; identical to SEQ ID NO: 9211

SEQ ID NO: 9287 - DNA, 201 bp, Homo sapiens; identical to SEQ ID NO: 9214

SEQ ID NO: 9288 - DNA, 201 bp, Homo sapiens; identical to SEQ ID NO: 9215

SEQ ID NO: 9289 - DNA, 201 bp, Homo sapiens; identical to SEQ ID NO: 9232

SEQ ID NO: 9290 - DNA, 164 bp, Homo sapiens; identical to SEQ ID NO: 9216

SEQ ID NO: 9291 - DNA, 146 bp, Homo sapiens; identical to SEQ ID NO: 9217

SEQ ID NO: 9292 - DNA, 201 bp, Homo sapiens; identical to SEQ ID NO: 9250

SEQ ID NO: 9293 - DNA, 201 bp, Homo sapiens; identical to SEQ ID NO: 9204

SEQ ID NO: 9294 - DNA, 201 bp, Homo sapiens; identical to SEQ ID NO: 9205

SEQ ID NO: 9295 - DNA, 201 bp, Homo sapiens; identical to SEQ ID NO: 9206

SEQ ID NO: 9296 - DNA, 201 bp, Homo sapiens; identical to SEQ ID NO: 9207

SEQ ID NO: 9297 - DNA, 201 bp, Homo sapiens; identical to SEQ ID NO: 9208

SEQ ID NO: 9298 - DNA, 201 bp, Homo sapiens; identical to SEQ ID NO: 9209

SEQ ID NO: 9299 - DNA, 201 bp, Homo sapiens; identical to SEQ ID NO: 9211

SEQ ID NO: 9300 - DNA, 201 bp, Homo sapiens; identical to SEQ ID NO: 9210

SEQ ID NO: 9301 - DNA, 124 bp, Homo sapiens; identical to SEQ ID NO: 9212

SEQ ID NO: 9302 - DNA, 201 bp, Homo sapiens; identical to SEQ ID NO: 9245

SEQ ID NO: 9303 - DNA, 201 bp, Homo sapiens; identical to SEQ ID NO: 9214

SEQ ID NO: 9304 - DNA, 201 bp, Homo sapiens; identical to SEQ ID NO: 9215

SEQ ID NO: 9305 - DNA, 164 bp, Homo sapiens; identical to SEQ ID NO: 9216

SEQ ID NO: 9306 - DNA, 146 bp, Homo sapiens; identical to SEQ ID NO: 9217

SEQ ID NO: 9307 - DNA, 201 bp, Homo sapiens
agcatcgaaccagagaatttctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtgggtgattcagggggcccgctgatgtgtgatggtgtgctccaaggt

SEQ ID NO: 9308 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaatttctcatttccagatgatctccagtgtgtggacctcaa

SEQ ID NO: 9309 - DNA, 201 bp, Homo sapiens
catttcagcactttccagtgtgggggcatcctggtgcaccgccagtgggtgctcacagctgctcattgcatcagcgacaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 9310 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaatttctcatttc

SEQ ID NO: 9311 - DNA, 201 bp, Homo sapiens
ctgtttggcttccggctggggcagcatcgaaccagagaatttctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtgggtgattcagggggcccgctgat

SEQ ID NO: 9312 - DNA, 201 bp, Homo sapiens
ccggctggggcagcatcgaaccagagaatttctcatttccagatgatctccagtgtgtggacctcaaaatcctgcctaatgatgagtgcaaaaaagcccaygtccagaaggtgacagacttcatgctgtgtgtcggacacctggaaggtggcaaagacacctgtgtgggtgattcagggggcccgctgatgtgtgatggtg

SEQ ID NO: 9313 - DNA, 201 bp, Homo sapiens
cctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaactctttcatcttcccattcgctgtctgtatttctc

SEQ ID NO: 9314 - DNA, 201 bp, Homo sapiens
caccctgtttctcactgccctcccctccgcctttctcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttg

SEQ ID NO: 9315 - DNA, 201 bp, Homo sapiens; identical to SEQ ID NO: 9310

SEQ ID NO: 9316 - DNA, 201 bp, Homo sapiens; identical to SEQ ID NO: 9311

SEQ ID NO: 9317 - DNA, 201 bp, Homo sapiens
cttttatccttctcatctgcctcttttttgctcaccctgtttctcactgccctcccctccgcctttctcacccctctgtccttttgagctcttttttgctstgtctcttcatttgccttttgcactctcaaactctttcatcttcccattcgctgtctgtatttctccataactatatctttcttcctctgtctccgccca

SEQ ID NO: 9318 - DNA, 160 bp, Homo sapiens
ctagttctcactctgacgtcccgcgtcctttttcatttgtctgcttctcgctcccttccrtgttctgttccctcttcctccctcttccctgggcctgtttctcgctgtccctgtcttttatccttctcatctgcctcttttttgctcaccctgtttctca

SEQ ID NO: 9319 - DNA, 201 bp, Homo sapiens; identical to SEQ ID NO: 9307

SEQ ID NO: 9320 - DNA, 201 bp, Homo sapiens
ccctcccccatgctcccctgccccatccccttttccccttcccgtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 9321 - DNA, 201 bp, Homo sapiens; identical to SEQ ID NO: 9308

SEQ ID NO: 9322 - DNA, 201 bp, Homo sapiens; identical to SEQ ID NO: 9312

SEQ ID NO: 9323 - DNA, 201 bp, Homo sapiens
ttcttcctctgtctccgcccacccacatttttctctttccctttctctctttggggaccctcccccatgctcccctgccccatccccttttccccttcccrtcttctcatccctccattcccatctttccccagcaattaccagctctggctgggtcgccacaacttgtttgacgacgaaaacacagcccagtttgttcat

SEQ ID NO: 9324 - DNA, 201 bp, Homo sapiens
atctggaaagtcagcgataacgagtcgtcatctaactatacctacaagatacatgtggcgggggagacagattcttccaatctcaacgtcagtgagcctcrcgctgtcatccccggactccgctccagcaccttctacaacatcacagtgtgtcctgtcctaggtgacatcgagggcacgccgggcttcctccaagtgcac

SEQ ID NO: 9325 - DNA, 201 bp, Homo sapiens
attggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttggatgccagcaatacagagagaagccgggcagggagccccaccgcccctgtgcat

SEQ ID NO: 9326 - DNA, 201 bp, Homo sapiens
tacaatgggaagctggaacctctgggctcctaccgggcttgtgtggctggcttcaccaacattaccttccaccctcaaaacaaggggctcattgatggggytgagagctatgtgtccttcagtcgctactcagatgctgtttccttgccccaggatccaggtgtcatctgtggagcggtttttggctgtatctttggtgcc

SEQ ID NO: 9327 - DNA, 106 bp, Homo sapiens
aaagtccactggctttcgtctctctctgccgtgacacatatcggaatctactgtatatatatatatatatatatatatatatatatatatatatatatatrcacta

SEQ ID NO: 9328 - DNA, 201 bp, Homo sapiens
tcataaaagtcatcacagagccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttc

SEQ ID NO: 9329 - DNA, 201 bp, Homo sapiens
tcacaggcttacgtccagcgacttcatatgtattctccatcactccaggaataggcaatgagacttggggagatcccagagtcataaaagtcatcacagarccgatcccagtttctgatctccgtgttgccctcacgggtgtgaggaaggctgctctctcctggagcaatggcaatggcactgcctcctgccgggttcttc

SEQ ID NO: 9330 - DNA, 201 bp, Homo sapiens
gtagcttagcatcagaggtttgcttcctcagtaacatttctgttctcatttgatcaggggaggcctctttgccccgaccccgcttcccctgccccctgtasatttgtgctccattttttcttcccttttccctcccagttttctccaaagactcttctgttggcaacattttcaacccattggttgggtgagaatggcgac

SEQ ID NO: 9331 - DNA, 201 bp, Homo sapiens
tggaatatacggaatatttaaacagtagcttagcatcagaggtttgcttcctcagtaacatttctgttctcatttgatcaggggaggcctctttgccccgrccccgcttcccctgccccctgtacatttgtgctccattttttcttcccttttccctcccagttttctccaaagactcttctgttggcaacattttcaacc

SEQ ID NO: 9332 - DNA, 201 bp, Homo sapiens
cgcgctgtcatccccggactccgctccagcaccttctacaacatcacagtgtgtcctgtcctaggtgacatcgagggcacgccgggcttcctccaagtgcrcaccccccctgttccagtttctgacttccgagtgacagtggtcagcacgacggagatcggcttagcatggagcagccatgatgcagaatcatttcagatg

SEQ ID NO: 9333 - DNA, 201 bp, Homo sapiens
gccagcaatacagagagaagccgggcagggagccccaccgcccctgtgcatgatgagtccctcgtgggacctgtggacccatcctccggccagcagtcccragacacggaagtcctgcttgtcgggttagagcctggcacccgatacaatgccaccgtttattcccaagcagcgaatggcacagaaggacagccccaggcc

SEQ ID NO: 9334 - DNA, 201 bp, Homo sapiens
aaatggacctgccctcctggcgccaatgcaggctttgagctggaggtcagcagtggagcctggaacaatgcgacccacctggagagctgctcctctgagartggcactgagtatagaacggaagtcacgtatttgaatttttctacctcgtacaacatcagcatcaccactgtgtcctgtggaaagatggcagcccccacc

SEQ ID NO: 9335 - DNA, 201 bp, Homo sapiens
gtgacatcgagggcacgccgggcttcctccaagtgcacaccccccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatca

SEQ ID NO: 9336 - DNA, 201 bp, Homo sapiens
gatttgaagccagccacggacccatcaaagcctatgctgtcattctcaccaccggggaagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaa

SEQ ID NO: 9337 - DNA, 152 bp, Homo sapiens
gaacacttcagcgtgaattcagtgtcagattaatccctccttccccaaagtccactggctttcgtctctctctgccgtgacacatatcggaatctactgtrtatatatatatatatatatatatatatatatatatatatatatatgcacta

SEQ ID NO: 9338 - DNA, 201 bp, Homo sapiens
tcctggccagaccacggtgttcccgacaccactgacctgctcatcaacttccggtacctcgttcgtgactacatgaagcagagtcctcccgaatcgccgaytctggtgcattgcagtgctggggtcggaaggacgggcactttcattgccattgatcgtctcatctaccagatagagaatgagaacaccgtggatgtgtat

SEQ ID NO: 9339 - DNA, 201 bp, Homo sapiens
tcaatcagtgtgttttggatattgtcagatcccagaaagactcaaaagtagatcttatctaccagaacacaactgcaatgacaatctatgaaaaccttgcrcccgtgaccacatttggaaagaccaatggttacatcgcctaattccaaaggaataacctttctggagtgaaccagaccgtcgcacccacagcgaaggcac

SEQ ID NO: 9340 - DNA, 201 bp, Homo sapiens
aatgagaagacaattactgttgtgcatcaaccatggtgtaacatcacaggcttacgtccagcgacttcatatgtattctccatcactccaggaataggcartgagacttggggagatcccagagtcataaaagtcatcacagagccgatcccagtttctgatctccgtgttgccctcacgggtgtgaggaaggctgctctc

SEQ ID NO: 9341 - DNA, 201 bp, Homo sapiens
gaatatacggaatatttaaacagtagcttagcatcagaggtttgcttcctcagtaacatttctgttctcatttgatcaggggaggcctctttgccccgacyccgcttcccctgccccctgtacatttgtgctccattttttcttcccttttccctcccagttttctccaaagactcttctgttggcaacattttcaaccca

SEQ ID NO: 9342 - DNA, 201 bp, Homo sapiens
cacccgatacaatgccaccgtttattcccaagcagcgaatggcacagaaggacagccccaggccatagagttcaggacaaatgctattcaggtttttgacrtcaccgctgtgaacatcagtgccacaagcctgaccctgatctggaaagtcagcgataacgagtcgtcatctaactatacctacaagatacatgtggcggg

SEQ ID NO: 9343 - DNA, 201 bp, Homo sapiens
ctcgggcctgaagccaggggttcaatacaacatcaacccgtatcttctaccatcaaataagacaaagggagaccccttgggcacagaaggtggcttggatrccagcaatacagagagaagccgggcagggagccccaccgcccctgtgcatgatgagtccctcgtgggacctgtggacccatcctccggccagcagtccca

SEQ ID NO: 9344 - DNA, 201 bp, Homo sapiens
tgggtggggagcaaatcatctgcattcctgatgaccaatgggatgaggtcactttttttttttttcccccttgaggattgtggaaaaccaggaaaagggakctatgatttttttttccaaaacaatttcttttttaaaaaagactattttatatgattcacatgctaaagccaggattgtgttgggttgaatatattttaa

SEQ ID NO: 9345 - DNA, 201 bp, Homo sapiens
gggctgtcgggggctgtggatgggtggggagcaaatcatctgcattcctgatgaccaatgggatgaggtcactttttttttttttcccccttgaggattgyggaaaaccaggaaaagggagctatgatttttttttccaaaacaatttcttttttaaaaaagactattttatatgattcacatgctaaagccaggattgtg

SEQ ID NO: 9346 - DNA, 201 bp, Homo sapiens
aagactcaaaagtagatcttatctaccagaacacaactgcaatgacaatctatgaaaaccttgcgcccgtgaccacatttggaaagaccaatggttacatmgcctaattccaaaggaataacctttctggagtgaaccagaccgtcgcacccacagcgaaggcacatgccccgatgtcgacatgtttttatatgtctaata

SEQ ID NO: 9347 - DNA, 201 bp, Homo sapiens
gctcctaccgggcttgtgtggctggcttcaccaacattaccttccaccctcaaaacaaggggctcattgatggggctgagagctatgtgtccttcagtcgytactcagatgctgtttccttgccccaggatccaggtgtcatctgtggagcggtttttggctgtatctttggtgccctggttattgtgactgtgggaggct

SEQ ID NO: 9348 - DNA, 201 bp, Homo sapiens; identical to SEQ ID NO: 9324

SEQ ID NO: 9349 - DNA, 201 bp, Homo sapiens; identical to SEQ ID NO: 9325

SEQ ID NO: 9350 - DNA, 201 bp, Homo sapiens
tgggaagctggaacctctgggctcctaccggtaatggcttgtgtggctggcttcaccaacattaccttccaccctcaaaacaaggggctcattgatggggytgagagctatgtgtccttcagtcgctactcagatgctgtttccttgccccaggatccaggtgtcatctgtggagcggtttttggctgtatctttggtgcc

SEQ ID NO: 9351 - DNA, 106 bp, Homo sapiens; identical to SEQ ID NO: 9327

SEQ ID NO: 9352 - DNA, 201 bp, Homo sapiens; identical to SEQ ID NO: 9328

SEQ ID NO: 9353 - DNA, 201 bp, Homo sapiens; identical to SEQ ID NO: 9329

SEQ ID NO: 9354 - DNA, 201 bp, Homo sapiens; identical to SEQ ID NO: 9330

SEQ ID NO: 9355 - DNA, 201 bp, Homo sapiens; identical to SEQ ID NO: 9331

SEQ ID NO: 9356 - DNA, 201 bp, Homo sapiens; identical to SEQ ID NO: 9332

SEQ ID NO: 9357 - DNA, 201 bp, Homo sapiens; identical to SEQ ID NO: 9333

SEQ ID NO: 9358 - DNA, 201 bp, Homo sapiens; identical to SEQ ID NO: 9334

SEQ ID NO: 9359 - DNA, 201 bp, Homo sapiens; identical to SEQ ID NO: 9335

SEQ ID NO: 9360 - DNA, 201 bp, Homo sapiens; identical to SEQ ID NO: 9336

SEQ ID NO: 9361 - DNA, 152 bp, Homo sapiens; identical to SEQ ID NO: 9337

SEQ ID NO: 9362 - DNA, 201 bp, Homo sapiens; identical to SEQ ID NO: 9338

SEQ ID NO: 9363 - DNA, 201 bp, Homo sapiens; identical to SEQ ID NO: 9340

SEQ ID NO: 9364 - DNA, 201 bp, Homo sapiens; identical to SEQ ID NO: 9339

SEQ ID NO: 9365 - DNA, 201 bp, Homo sapiens; identical to SEQ ID NO: 9341

SEQ ID NO: 9366 - DNA, 201 bp, Homo sapiens; identical to SEQ ID NO: 9342

SEQ ID NO: 9367 - DNA, 201 bp, Homo sapiens; identical to SEQ ID NO: 9345

SEQ ID NO: 9368 - DNA, 201 bp, Homo sapiens; identical to SEQ ID NO: 9344

SEQ ID NO: 9369 - DNA, 201 bp, Homo sapiens; identical to SEQ ID NO: 9343

SEQ ID NO: 9370 - DNA, 201 bp, Homo sapiens
taccggtaatggcttgtgtggctggcttcaccaacattaccttccaccctcaaaacaaggggctcattgatggggctgagagctatgtgtccttcagtcgytactcagatgctgtttccttgccccaggatccaggtgtcatctgtggagcggtttttggctgtatctttggtgccctggttattgtgactgtgggaggct

SEQ ID NO: 9371 - DNA, 201 bp, Homo sapiens; identical to SEQ ID NO: 9346

SEQ ID NO: 9372 - DNA, 201 bp, Homo sapiens
tcaatcagtgtgttttggatattgtcagatcccagaaagactcaaaagtagatcttatctaccagaacacaactgcaatgacaatctatgaaaaccttgcrcccgtgaccacatttggaaagaccaatgaaaagcagctggtatgggtttgggtgtcaatgaaagggccaaagactggtggccagctggtttgggggattt

SEQ ID NO: 9373 - DNA, 201 bp, Homo sapiens
ggatcgaggggcgggggtcagctatgcagcccatcacgtgtgtttttcatctgggatgaaaaagcctggttctcttttgaaatgcttgattgtacttattkagctaaacaagtcttggtgactgttgttgatttgcctcaaaagttttaagtcctgggttttcagactactgtgtagcagctgtgtgtttaacatactgta

SEQ ID NO: 9374 - DNA, 118 bp, Homo sapiens
atgcctgggtacattgcrtgctctggggaccagtatgttttcctcaatcagtgtgttttggatattgtcagatcccagaaagactcaaaagtagatcttatctaccagaacacaactg

SEQ ID NO: 9375 - DNA, 201 bp, Homo sapiens; identical to SEQ ID NO: 9324

SEQ ID NO: 9376 - DNA, 201 bp, Homo sapiens; identical to SEQ ID NO: 9325

SEQ ID NO: 9377 - DNA, 201 bp, Homo sapiens; identical to SEQ ID NO: 9326

SEQ ID NO: 9378 - DNA, 106 bp, Homo sapiens; identical to SEQ ID NO: 9327

SEQ ID NO: 9379 - DNA, 201 bp, Homo sapiens; identical to SEQ ID NO: 9328

SEQ ID NO: 9380 - DNA, 201 bp, Homo sapiens; identical to SEQ ID NO: 9329

SEQ ID NO: 9381 - DNA, 201 bp, Homo sapiens; identical to SEQ ID NO: 9330

SEQ ID NO: 9382 - DNA, 201 bp, Homo sapiens; identical to SEQ ID NO: 9331

SEQ ID NO: 9383 - DNA, 201 bp, Homo sapiens; identical to SEQ ID NO: 9332

SEQ ID NO: 9384 - DNA, 201 bp, Homo sapiens; identical to SEQ ID NO: 9333

SEQ ID NO: 9385 - DNA, 201 bp, Homo sapiens; identical to SEQ ID NO: 9334

SEQ ID NO: 9386 - DNA, 201 bp, Homo sapiens; identical to SEQ ID NO: 9335

SEQ ID NO: 9387 - DNA, 201 bp, Homo sapiens; identical to SEQ ID NO: 9336

SEQ ID NO: 9388 - DNA, 152 bp, Homo sapiens; identical to SEQ ID NO: 9337

SEQ ID NO: 9389 - DNA, 201 bp, Homo sapiens; identical to SEQ ID NO: 9338

SEQ ID NO: 9390 - DNA, 201 bp, Homo sapiens; identical to SEQ ID NO: 9340

SEQ ID NO: 9391 - DNA, 201 bp, Homo sapiens; identical to SEQ ID NO: 9339

SEQ ID NO: 9392 - DNA, 201 bp, Homo sapiens; identical to SEQ ID NO: 9341

SEQ ID NO: 9393 - DNA, 201 bp, Homo sapiens; identical to SEQ ID NO: 9342

SEQ ID NO: 9394 - DNA, 201 bp, Homo sapiens; identical to SEQ ID NO: 9345

SEQ ID NO: 9395 - DNA, 201 bp, Homo sapiens; identical to SEQ ID NO: 9344

SEQ ID NO: 9396 - DNA, 201 bp, Homo sapiens; identical to SEQ ID NO: 9343

SEQ ID NO: 9397 - DNA, 201 bp, Homo sapiens; identical to SEQ ID NO: 9346

SEQ ID NO: 9398 - DNA, 201 bp, Homo sapiens; identical to SEQ ID NO: 9347

SEQ ID NO: 9399 - DNA, 201 bp, Homo sapiens
agtatgtcgaatcagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacggga

SEQ ID NO: 9400 - DNA, 201 bp, Homo sapiens
cttcatgaaccccgggatggagcggctgatatcctgaatcttgcccctccagagacaggaaagaatttgccttctccctgggaactggttcaagagacacwgcttgggttcctttttcaacttggaaaaagaaagaaacactcaacaataaagactgagacccgttcgcccccatgtgacttttatctgtagcagaaacca

SEQ ID NO: 9401 - DNA, 201 bp, Homo sapiens
ctccctgggaactggttcaagagacactgcttgggttcctttttcaacttggaaaaagaaagaaacactcaacaataaagactgagacccgttcgcccccrtgtgacttttatctgtagcagaaaccaagtctacttcactaatgacgatgccgtgtgtctcgtctcctgacatgtctcacagacgctcctgaagttaggt

SEQ ID NO: 9402 - DNA, 201 bp, Homo sapiens
ggatgaggaggagctcttccactccatccgcatggacaatcccttttacccacggtggctggagaaggaagcaaaggaccttctggtgaagctcttcgtgmgagaacctgagaagaggctgggcgtgaggggagacatccgccagcaccctttgtttcgggagatcaactgggaggaacttgaacggaaggagattgaccc

SEQ ID NO: 9403 - DNA, 201 bp, Homo sapiens
tggtcttgatggacgatgatgttgagtgcacgatggtagagaagagagttctttccttggcctgggagcatccgtttctgacgcacatgttttgtacattycagaccaaggaaaacctcttttttgtgatggagtacctcaacggaggggacttaatgtaccacatccaaagctgccacaagttcgacctttccagagcga

SEQ ID NO: 9404 - DNA, 201 bp, Homo sapiens
gagatgccaagacgaataccttctgtgggacacctgactacatcgccccagagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacc

SEQ ID NO: 9405 - DNA, 201 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggaaaacctcttttttgtgatggagtacctcaacggaggggacttaatgtaccacatccaaagctgccacaagt

SEQ ID NO: 9406 - DNA, 201 bp, Homo sapiens
aagactgaaacggccccattgcctggtctagtagcggatctcactcagccgcagacaagtaatcactaacccgttttattctattcctatctgtggatgtrtaaatggctggggggccagccctggataggtttttatgggaattctttacaataaacatagcttgtaacttgagatctacaaatccattcatcctgattg

SEQ ID NO: 9407 - DNA, 201 bp, Homo sapiens
ctccagtattggcacagtcactcactgccattctcacactataacaagaaaagaaatgaagtgcataagtctcctgggaaaagaaccttaaccccttctcrtgccatgactggtgatttcatgactcataagcccctccgtaggcatcattcaagatcaatggcccatgcatgctgtttgcagcagtcaattgagttgaat

SEQ ID NO: 9408 - DNA, 201 bp, Homo sapiens
aaatcattcttggtctgcagttccttcattccaaaggaatagtctacagggacctgaagctagataacatcctgttagacaaagatggacatatcaagatygcggattttggaatgtgcaaggagaacatgttaggagatgccaagacgaataccttctgtgggacacctgactacatcgccccagagatcttgctgggtc

SEQ ID NO: 9409 - DNA, 201 bp, Homo sapiens
gtgatgcatgtggcatgaatgtgcatcatagatgccagacaaaggtggccaacctttgtggcataaaccagaagctaatggctgaagcgctggccatgatwgagagcactcaacaggctcgctgcttaagagatactgaacagatcttcagagaaggtccggttgaaattggtctcccatgctccatcaaaaatgaagcaa

SEQ ID NO: 9410 - DNA, 133 bp, Homo sapiens
catgctgtttgcagcagtcaattgagttgaattagaattccaaccatacattttaaaggtatttgtgctgtgtgtatattttgataaaatgttgtgacttmatggcaaacaggtggatgtgtaaaaatggaat

SEQ ID NO: 9411 - DNA, 201 bp, Homo sapiens
agcactcaacaggctcgctgcttaagagatactgaacagatcttcagagaaggtccggttgaaattggtctcccatgctccatcaaaaatgaagcaaggcygccatgtttaccgacaccgggaaaaagagagcctcagggcatttcctgggagtctccgttggatgaggtggataaaatgtgccatcttccagaacctgaa

SEQ ID NO: 9412 - DNA, 201 bp, Homo sapiens
agacaggaaagaatttgccttctccctgggaactggttcaagagacactgcttgggttcctttttcaacttggaaaaagaaagaaacactcaacaataaakactgagacccgttcgcccccatgtgacttttatctgtagcagaaaccaagtctacttcactaatgacgatgccgtgtgtctcgtctcctgacatgtctca

SEQ ID NO: 9413 - DNA, 201 bp, Homo sapiens
gttatttacttgaaagatgggtctccgcacttggaaaggtttcaagacttgatactgcaataaattatggctcttcacctgggcgccaactgctgatcaaygaaatgcttgttgaatcaggggcaaacggagtacagacgtctcaagactgaaacggccccattgcctggtctagtagcggatctcactcagccgcagaca

SEQ ID NO: 9414 - DNA, 201 bp, Homo sapiens
aaattatggctcttcacctgggcgccaactgctgatcaatgaaatgcttgttgaatcaggggcaaacggagtacagacgtctcaagactgaaacggccccrttgcctggtctagtagcggatctcactcagccgcagacaagtaatcactaacccgttttattctattcctatctgtggatgtgtaaatggctggggggcc

SEQ ID NO: 9415 - DNA, 201 bp, Homo sapiens; identical to SEQ ID NO: 9399

SEQ ID NO: 9416 - DNA, 201 bp, Homo sapiens; identical to SEQ ID NO: 9400

SEQ ID NO: 9417 - DNA, 201 bp, Homo sapiens; identical to SEQ ID NO: 9401

SEQ ID NO: 9418 - DNA, 201 bp, Homo sapiens; identical to SEQ ID NO: 9402

SEQ ID NO: 9419 - DNA, 201 bp, Homo sapiens; identical to SEQ ID NO: 9403

SEQ ID NO: 9420 - DNA, 201 bp, Homo sapiens; identical to SEQ ID NO: 9404

SEQ ID NO: 9421 - DNA, 201 bp, Homo sapiens; identical to SEQ ID NO: 9405

SEQ ID NO: 9422 - DNA, 201 bp, Homo sapiens; identical to SEQ ID NO: 9406

SEQ ID NO: 9423 - DNA, 201 bp, Homo sapiens; identical to SEQ ID NO: 9407

SEQ ID NO: 9424 - DNA, 201 bp, Homo sapiens; identical to SEQ ID NO: 9408

SEQ ID NO: 9425 - DNA, 201 bp, Homo sapiens; identical to SEQ ID NO: 9409

SEQ ID NO: 9426 - DNA, 133 bp, Homo sapiens; identical to SEQ ID NO: 9410

SEQ ID NO: 9427 - DNA, 201 bp, Homo sapiens; identical to SEQ ID NO: 9411

SEQ ID NO: 9428 - DNA, 201 bp, Homo sapiens; identical to SEQ ID NO: 9412

SEQ ID NO: 9429 - DNA, 201 bp, Homo sapiens; identical to SEQ ID NO: 9413

SEQ ID NO: 9430 - DNA, 201 bp, Homo sapiens; identical to SEQ ID NO: 9414

SEQ ID NO: 9431 - DNA, 201 bp, Homo sapiens; identical to SEQ ID NO: 9399

SEQ ID NO: 9432 - DNA, 140 bp, Homo sapiens
tggtcttgatggacgatgatgttgagtgcacgatggtagagaagagagttctttccttggcctgggagcatccgtttctgacgcacatgttttgtacattycagaccaaggtatggcttctgctccgacaaccctacctc

SEQ ID NO: 9433 - DNA, 158 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggtatggcttctgctccgacaaccctacctc

SEQ ID NO: 9434 - DNA, 201 bp, Homo sapiens; identical to SEQ ID NO: 9411

SEQ ID NO: 9435 - DNA, 201 bp, Homo sapiens; identical to SEQ ID NO: 9409

SEQ ID NO: 9436 - DNA, 201 bp, Homo sapiens
cactgcccatctggatgatgcagaccatgtgctcccccaagtggcagctgggtctagctttcttgcctgccagtgtgtcctacctcattggcaccaacctytttggtgtgttggccaacaagatgggtcggtggctgtgttccctaatcgggatgctggtagtaggtaccagcttgctctgtgttcctctggctcacaata

SEQ ID NO: 9437 - DNA, 106 bp, Homo sapiens
cacacrcacacatacacagaatcctcagataacaggaggcaataaatccaacagcacatccacgttcagagaacagtgtccctgctgtcttgctaacagctgccaa

SEQ ID NO: 9438 - DNA, 201 bp, Homo sapiens
aaaagggctttaccctcagtgaaaagtgtcttctattttcattatctttcagaaacaggagcccatttctcttctgctggagttattgacattctcctgasctcccctgtgtgttcctaccttttctgaacctcttagactcttagaaataaaagtagaagaaagacagaaaaaataactgattagacccaagatttcatg

SEQ ID NO: 9439 - DNA, 201 bp, Homo sapiens
cagggcttggccttgccataggcatggtggattcttctatgatgcccatcatggggcacctggtggatctacgccacacctcggtgtatgggagtgtctaygccatcgctgatgtggctttttgcatgggctttgctataggtccatccaccggtggtgccattgtaaaggccatcggttttccctggctcatggtcatca

SEQ ID NO: 9440 - DNA, 201 bp, Homo sapiens
ctcttccataaaggctgcaggagacctgtagctgtcacaggaccttccctaagagcccgcaggggaagactgccccagtccggccatcaccatgctccggmccattctggatgctccccagcggttgctgaaggaggggagagcgtcccggcagctggtgctggtggtggtattcgtcgctttgctcctggacaacatgct

SEQ ID NO: 9441 - DNA, 201 bp, Homo sapiens
gttggccaacaagatgggtcggtggctgtgttccctaatcgggatgctggtagtaggtaccagcttgctctgtgttcctctggctcacaatatttttggtstcattggccccaatgcagggcttggccttgccataggcatggtggattcttctatgatgcccatcatggggcacctggtggatctacgccacacctcggt

SEQ ID NO: 9442 - DNA, 201 bp, Homo sapiens
tgccagcaccatcccacctccagccactgaagccatctcagctcataaaaacaactgcttgcaaggcacaggtttcttggaggaagagactacccgggtcrgggttctgtttgcttcaaaggctgtgatgcaacttctggtcaacccattcgtgggccctctcaccaacaggattggatatcatatccccatgtttgctgg

SEQ ID NO: 9443 - DNA, 201 bp, Homo sapiens
ggccagtgtctacactgatgaccatgagagaggacgagccatgggaactgctctggggggcctggccttggggttgctggtgggagctccctttggaagtrtaatgtacgagtttgttgggaagtctgcacccttcctcatcctggccttcctggcactactggatggagcactccagctttgcatcctacagccttccaa

SEQ ID NO: 9444 - DNA, 164 bp, Homo sapiens
tagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagac

SEQ ID NO: 9445 - DNA, 201 bp, Homo sapiens
tggtgggagctccctttggaagtgtaatgtacgagtttgttgggaagtctgcacccttcctcatcctggccttcctggcactactggatggagcactccarctttgcatcctacagccttccaaagtctctcctgagagtgccaaggggactcccctctttatgcttctcaaagacccttacatcctggtggctgcagggt

SEQ ID NO: 9446 - DNA, 201 bp, Homo sapiens
catgccggaagttccccacatgccctcgcctctcctgccttttccaccatcttctccttcttcaacaacaacaccgtggctgttgaagaaagcgtacctastggaatagcatggatgaatgacactgccagcaccatcccacctccagccactgaagccatctcagctcataaaaacaactgcttgcaaggcacaggtttc

SEQ ID NO: 9447 - DNA, 201 bp, Homo sapiens
ccattgtaaaggccatcggttttccctggctcatggtcatcactggggtcatcaacatcgtctatgctccactctgctactacctgcggagccccccggcraaggaagagaagcttgctattctgagtcaggactgccccatggagacccggatgtatgcaacccagaagcccacgaaggaatttcctctgggggaggaca

SEQ ID NO: 9448 - DNA, 201 bp, Homo sapiens
agcacatccacgttcagagaacagtgtccctgctgtcttgctaacagctgccaatacctcactgagtgcctcacaccaacatgggctccaagtgagtttcmttcgtctgggcagactccctcccctcttccataaaggctgcaggagacctgtagctgtcacaggaccttccctaagagcccgcaggggaagactgcccca

SEQ ID NO: 9449 - DNA, 201 bp, Homo sapiens
gagactacccgggtcggggttctgtttgcttcaaaggctgtgatgcaacttctggtcaacccattcgtgggccctctcaccaacaggattggatatcatayccccatgtttgctggctttgttatcatgtttctctccacagttatgtttgctttttctgggacctatactctactctttgtggcccgaacccttcaaggc

SEQ ID NO: 9450 - DNA, 201 bp, Homo sapiens
atgaatgacactgccagcaccatcccacctccagccactgaagccatctcagctcataaaaacaactgcttgcaaggcacaggtttcttggaggaagagaytacccgggtcggggttctgtttgcttcaaaggctgtgatgcaacttctggtcaacccattcgtgggccctctcaccaacaggattggatatcatatcccc

SEQ ID NO: 9451 - DNA, 201 bp, Homo sapiens
tctacactgatgaccatgagagaggacgagccatgggaactgctctggggggcctggccttggggttgctggtgggagctccctttggaagtgtaatgtaygagtttgttgggaagtctgcacccttcctcatcctggccttcctggcactactggatggagcactccagctttgcatcctacagccttccaaagtctctc

SEQ ID NO: 9452 - DNA, 201 bp, Homo sapiens
ggactcccctctttatgcttctcaaagacccttacatcctggtggctgcaggtctagctttcttgcctgccagtgtgtcctacctcattggcaccaacctytttggtgtgttggccaacaagatgggtcggtggctgtgttccctaatcgggatgctggtagtaggtaccagcttgctctgtgttcctctggctcacaata

SEQ ID NO: 9453 - DNA, 106 bp, Homo sapiens; identical to SEQ ID NO: 9437

SEQ ID NO: 9454 - DNA, 201 bp, Homo sapiens; identical to SEQ ID NO: 9438

SEQ ID NO: 9455 - DNA, 201 bp, Homo sapiens; identical to SEQ ID NO: 9439

SEQ ID NO: 9456 - DNA, 201 bp, Homo sapiens; identical to SEQ ID NO: 9440

SEQ ID NO: 9457 - DNA, 201 bp, Homo sapiens
gttggccaacaagatgggtcggtggctgtgttccctaatcgggatgctggtagtaggtaccagcttgctctgtgttcctctggctcacaatatttttggtvtcattggccccaatgcagggcttggccttgccataggcatggtggattcttctatgatgcccatcatggggcacctggtggatctacgccacacctcggt

SEQ ID NO: 9458 - DNA, 201 bp, Homo sapiens; identical to SEQ ID NO: 9442

SEQ ID NO: 9459 - DNA, 201 bp, Homo sapiens; identical to SEQ ID NO: 9443

SEQ ID NO: 9460 - DNA, 164 bp, Homo sapiens; identical to SEQ ID NO: 9444

SEQ ID NO: 9461 - DNA, 201 bp, Homo sapiens
tggtgggagctccctttggaagtgtaatgtacgagtttgttgggaagtctgcacccttcctcatcctggccttcctggcactactggatggagcactccarctttgcatcctacagccttccaaagtctctcctgagagtgccaaggggactcccctctttatgcttctcaaagacccttacatcctggtggctgcaggtc

SEQ ID NO: 9462 - DNA, 201 bp, Homo sapiens; identical to SEQ ID NO: 9446

SEQ ID NO: 9463 - DNA, 201 bp, Homo sapiens; identical to SEQ ID NO: 9447

SEQ ID NO: 9464 - DNA, 201 bp, Homo sapiens; identical to SEQ ID NO: 9448

SEQ ID NO: 9465 - DNA, 201 bp, Homo sapiens; identical to SEQ ID NO: 9449

SEQ ID NO: 9466 - DNA, 201 bp, Homo sapiens; identical to SEQ ID NO: 9450

SEQ ID NO: 9467 - DNA, 201 bp, Homo sapiens; identical to SEQ ID NO: 9451

SEQ ID NO: 9468 - DNA, 201 bp, Homo sapiens
cggtgaaggtccagcactcgggtgcctactggtgccaggggaccaacagtgtgggcaagggccgttcgcctctcagcaccctcaccgtctactatagcccrgagaccatcggcaggcgagtggctgtgggactcgggtcctgcctcgccatcctcatcctggcaatctgtgggctcaagctccagcgacgttggaagagga

SEQ ID NO: 9469 - DNA, 201 bp, Homo sapiens
aaaaggttagaagggcccccctctctgaagacccccactccctgggatgctacaatccaatgatggaagatggcattagctacaccaccctgcgctttccmgagatgaacataccacgaactggagatgcagagtcctcagagatgcagagacctcccccggactgcgatgacacggtcacttattcagcattgcacaagc

SEQ ID NO: 9470 - DNA, 201 bp, Homo sapiens
agtgatggaggggaagagtgcaaccctgacctgtgagagcgacgccaaccctcccgtctcccactacacctggtttgactggaataaccaaagcctccccyaccacagccagaagctgagattggagccggtgaaggtccagcactcgggtgcctactggtgccaggggaccaacagtgtgggcaagggccgttcgcctct

SEQ ID NO: 9471 - DNA, 177 bp, Homo sapiens
ggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcttacacctgtaatcccagc

SEQ ID NO: 9472 - DNA, 201 bp, Homo sapiens
ggacacttgaagtgctgtatgcacccaggaggctgcgtgtgtccatgagcccgggggaccaagtgatggaggggaagagtgcaaccctgacctgtgagagygacgccaaccctcccgtctcccactacacctggtttgactggaataaccaaagcctcccctaccacagccagaagctgagattggagccggtgaaggtcc

SEQ ID NO: 9473 - DNA, 201 bp, Homo sapiens
tggaagaggacacagagccagcaggggcttcaggagaattccagcggccagagcttctttgtgaggaataaaaaggttagaagggcccccctctctgaagrcccccactccctgggatgctacaatccaatgatggaagatggcattagctacaccaccctgcgctttcccgagatgaacataccacgaactggagatgca

SEQ ID NO: 9474 - DNA, 201 bp, Homo sapiens
cccagcactttgggaggccaaggcgggaggatcacttgaggtcaggagttcaagaccagcctggccaacatggcgaaaccctgtctctactagaaatacaraaaaattagctgggtgtggtggtgggcacctgtaatcccagctactcgggaggctgaggcaggaggatcacttgaactggggaggtagaggttacagcga

SEQ ID NO: 9475 - DNA, 201 bp, Homo sapiens
cgagattcactctggaaactcggtcagcctccaatgtgacttctcaagcagccaccccaaagaagtccagttcttctgggagaaaaatggcaggcttctgrggaaagaaagccagctgaattttgactccatctccccagaagatgctgggagttacagctgctgggtgaacaactccataggacagacagcgtccaaggc

SEQ ID NO: 9476 - DNA, 108 bp, Homo sapiens
ggactgcrttgggtgcagtggttcccgcctgtaaccccagcactttgggaggctgagatcggaggatcgtttgagcccaggagtttgagaccagcctgggtaacatgg

SEQ ID NO: 9477 - DNA, 201 bp, Homo sapiens
aaagcaggactggagagaggtggaatgaagtggcaaggggttcctgaggggtgatttgggacaggacatctaaagccaggtgtacgctcacgtcctcagtsccccaggctcctgcacgggctctgttcttttgcagaaaggccttttccacctcatatccagctccctccagaaattcaagagtcccaggaagtcactctg

SEQ ID NO: 9478 - DNA, 201 bp, Homo sapiens
ttacccggtatgaatggaaaccccatggcgcctgggaggagccatcgcttggggtgctgaagatccaaaacgttggctgggacaacacaaccatcgcctghgcagcttgtaatagttggtgctcgtgggcctcccctgtcgccctgaatgtccagtatgccccccgagacgtgagggtccggaaaatcaagcccctttccg

SEQ ID NO: 9479 - DNA, 201 bp, Homo sapiens
cggtgaaggtccagcactcgggtgcctactggtgccaggggaccaacagtgtgggcaagggccgttcgcctctcagcaccctcaccgtctactatagcccrgagaccatcggcaggcgagtggctgtgggactcgggtcctgcctcgccatcctcatcctggcaatctgtgggctcaagctccagcgacgagatgcagagt

SEQ ID NO: 9480 - DNA, 201 bp, Homo sapiens; identical to SEQ ID NO: 9470

SEQ ID NO: 9481 - DNA, 201 bp, Homo sapiens
caatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggagctgagctggatgtccagtatcctcccaagaaggtgaccac

SEQ ID NO: 9482 - DNA, 201 bp, Homo sapiens; identical to SEQ ID NO: 9472

SEQ ID NO: 9483 - DNA, 201 bp, Homo sapiens
aaaccctctacgcctgggagggggcctgcgtctggatcccctgcacctacagagccctagatggtgacctggaaagcttcatcctgttccacaatcctgartataacaagaacacctcgaagtttgatgggacaagactctatgaaagcacaaaggatgggaaggttccttctgagcagaaaagggtgcaattcctgggag

SEQ ID NO: 9484 - DNA, 201 bp, Homo sapiens
agaggagaaagtccacatcccaaagatcctcccctggcacgctgggacttattcctgtgtggcagaaaacattcttggtactggacagaggggcccgggarctgagctggatgtccagtatcctcccaagaaggtgaccacagtgattcaaaaccccatgccgattcgagaaggagacacagtgaccctttcctgtaacta

SEQ ID NO: 9485 - DNA, 201 bp, Homo sapiens
gaaagtccacatcccaaagatcctcccctggcacgctgggacttattcctgtgtggcagaaaacattcttggtactggacagaggggcccgggagctgagytggatgtccagtatcctcccaagaaggtgaccacagtgattcaaaaccccatgccgattcgagaaggagacacagtgaccctttcctgtaactacaattc

SEQ ID NO: 9486 - DNA, 201 bp, Homo sapiens; identical to SEQ ID NO: 9475

SEQ ID NO: 9487 - DNA, 201 bp, Homo sapiens; identical to SEQ ID NO: 9478

SEQ ID NO: 9488 - DNA, 201 bp, Homo sapiens; identical to SEQ ID NO: 9474

SEQ ID NO: 9489 - DNA, 201 bp, Homo sapiens; identical to SEQ ID NO: 9477

SEQ ID NO: 9490 - DNA, 201 bp, Homo sapiens
agtcaccatgggaagattgtgacctgccagcttcaggatgcagatgggaagttcctctccaatgacacggtgcagctgaacgtgaagcgtgagtctccccrgcatgcctgtgggaagggcaaggtctgtgtcaccttctccccagccccgcagggggcatgcacccagggcagggggaagcctgcacagacggcggcatcc

SEQ ID NO: 9491 - DNA, 201 bp, Homo sapiens; identical to SEQ ID NO: 9468

SEQ ID NO: 9492 - DNA, 201 bp, Homo sapiens; identical to SEQ ID NO: 9469

SEQ ID NO: 9493 - DNA, 201 bp, Homo sapiens; identical to SEQ ID NO: 9470

SEQ ID NO: 9494 - DNA, 201 bp, Homo sapiens; identical to SEQ ID NO: 9472

SEQ ID NO: 9495 - DNA, 201 bp, Homo sapiens; identical to SEQ ID NO: 9473

SEQ ID NO: 9496 - DNA, 201 bp, Homo sapiens
cagtttctgcctctgagggaaagcccagaaaaggacagaaacgaagtagaaaggggcccagtcctggcctggcttctcctttggaagtgaggcattgcacrgggagacgtacgtatcagcggccccttgactctggggactccgggtttgagatggacacactggtgtggattaacctgccagggagacagagctcacaat

SEQ ID NO: 9497 - DNA, 201 bp, Homo sapiens; identical to SEQ ID NO: 9475

SEQ ID NO: 9498 - DNA, 201 bp, Homo sapiens
tctccatctctctggccctctacccctgatctgacatccccactcacgaatattatgcccagtttctgcctctgagggaaagcccagaaaaggacagaaaygaagtagaaaggggcccagtcctggcctggcttctcctttggaagtgaggcattgcacggggagacgtacgtatcagcggccccttgactctggggactc

SEQ ID NO: 9499 - DNA, 201 bp, Homo sapiens; identical to SEQ ID NO: 9481

SEQ ID NO: 9500 - DNA, 201 bp, Homo sapiens; identical to SEQ ID NO: 9483

SEQ ID NO: 9501 - DNA, 201 bp, Homo sapiens; identical to SEQ ID NO: 9484

SEQ ID NO: 9502 - DNA, 201 bp, Homo sapiens
cactgggggcagcgggggccagggaagtccccgagtttccccagacaccgccacatggcttcctcctgcgcgcatgtgcgcacacacacacacacacgcasacacacacacacacactcactgcggagaaccttgtgcctggctcagagccagtctttttggtgagggtaaccccaaacctccaaaactcctgcccctgtt

SEQ ID NO: 9503 - DNA, 201 bp, Homo sapiens
ggatgggctgcagcagaggcactgggggcagcgggggccagggaagtccccgagtttccccagacaccgccacatggcttcctcctgcgcgcatgtgcgcrcacacacacacacacgcacacacacacacacacactcactgcggagaaccttgtgcctggctcagagccagtctttttggtgagggtaaccccaaacctc

SEQ ID NO: 9504 - DNA, 201 bp, Homo sapiens; identical to SEQ ID NO: 9478

SEQ ID NO: 9505 - DNA, 201 bp, Homo sapiens; identical to SEQ ID NO: 9485

SEQ ID NO: 9506 - DNA, 201 bp, Homo sapiens
caagacccctatctctaaaaagaataaaaaattaaacaaattttaaaataaaaaataacttttaaaagaaggctctcatgcccccttagtaatgctttctkatcactgtggtgagttctagaatacttggctttctctgactcaagtaaatgggtttttgagcaccctgaaaccctctacgcctgggagggggcctgcgtc

SEQ ID NO: 9507 - DNA, 201 bp, Homo sapiens; identical to SEQ ID NO: 9468

SEQ ID NO: 9508 - DNA, 201 bp, Homo sapiens; identical to SEQ ID NO: 9470

SEQ ID NO: 9509 - DNA, 201 bp, Homo sapiens; identical to SEQ ID NO: 9469

SEQ ID NO: 9510 - DNA, 201 bp, Homo sapiens; identical to SEQ ID NO: 9472

SEQ ID NO: 9511 - DNA, 201 bp, Homo sapiens; identical to SEQ ID NO: 9473

SEQ ID NO: 9512 - DNA, 201 bp, Homo sapiens; identical to SEQ ID NO: 9496

SEQ ID NO: 9513 - DNA, 201 bp, Homo sapiens; identical to SEQ ID NO: 9475

SEQ ID NO: 9514 - DNA, 201 bp, Homo sapiens; identical to SEQ ID NO: 9498

SEQ ID NO: 9515 - DNA, 201 bp, Homo sapiens; identical to SEQ ID NO: 9481

SEQ ID NO: 9516 - DNA, 201 bp, Homo sapiens; identical to SEQ ID NO: 9483

SEQ ID NO: 9517 - DNA, 201 bp, Homo sapiens; identical to SEQ ID NO: 9484

SEQ ID NO: 9518 - DNA, 201 bp, Homo sapiens; identical to SEQ ID NO: 9502

SEQ ID NO: 9519 - DNA, 201 bp, Homo sapiens; identical to SEQ ID NO: 9503

SEQ ID NO: 9520 - DNA, 201 bp, Homo sapiens; identical to SEQ ID NO: 9485

SEQ ID NO: 9521 - DNA, 201 bp, Homo sapiens; identical to SEQ ID NO: 9478

SEQ ID NO: 9522 - DNA, 201 bp, Homo sapiens; identical to SEQ ID NO: 9468

SEQ ID NO: 9523 - DNA, 201 bp, Homo sapiens; identical to SEQ ID NO: 9469

SEQ ID NO: 9524 - DNA, 201 bp, Homo sapiens; identical to SEQ ID NO: 9470

SEQ ID NO: 9525 - DNA, 201 bp, Homo sapiens; identical to SEQ ID NO: 9472

SEQ ID NO: 9526 - DNA, 201 bp, Homo sapiens; identical to SEQ ID NO: 9473

SEQ ID NO: 9527 - DNA, 201 bp, Homo sapiens; identical to SEQ ID NO: 9475

SEQ ID NO: 9528 - DNA, 201 bp, Homo sapiens; identical to SEQ ID NO: 9481

SEQ ID NO: 9529 - DNA, 201 bp, Homo sapiens; identical to SEQ ID NO: 9484

SEQ ID NO: 9530 - DNA, 201 bp, Homo sapiens; identical to SEQ ID NO: 9483

SEQ ID NO: 9531 - DNA, 201 bp, Homo sapiens; identical to SEQ ID NO: 9485

SEQ ID NO: 9532 - DNA, 201 bp, Homo sapiens; identical to SEQ ID NO: 9478

SEQ ID NO: 9533 - DNA, 179 bp, Homo sapiens
ttagtgtccttcttaacagactcaaaccacatggaccacgaatattctttctgtccagaagggctactttccacatatagagctccagggactgtcttttytgtattcgctgttcaataaacattgagtgagcacctccccagatggagcatgctggtcctgggccatgactcaaacca

SEQ ID NO: 9534 - DNA, 201 bp, Homo sapiens
ctaccccatccctctggtgtgagccgtggcagccgcagcgcagactggcggagaaggagaggaacgggcagcctgggcctgggtggaaatcctgccctggrggaagttgtggggagatccactgggacccccaacattctgccctcacctctgtgcccagcctggaaacctacagacaaggaggagttccaccatgagctc

SEQ ID NO: 9535 - DNA, 201 bp, Homo sapiens
cgcagactggcggagaaggagaggaacgggcagcctgggcctgggtggaaatcctgccctggaggaagttgtggggagatccactgggacccccaacattytgccctcacctctgtgcccagcctggaaacctacagacaaggaggagttccaccatgagctcacccgtgtctatgacgcaaagatcaccagccatgtgcc

SEQ ID NO: 9536 - DNA, 201 bp, Homo sapiens
acccgtgtctatgacgcaaagatcaccagccatgtgccttagtgtccttcttaacagactcaaaccacatggaccacgaatattctttctgtccagaaggrctactttccacatatagagctccagggactgtcttttctgtattcgctgttcaataaacattgagtgagcacctccccagatggagcatgctggtcctgg

SEQ ID NO: 9537 - DNA, 201 bp, Homo sapiens
caccactggggccctggagtctgcgatcgccatcgcaaccggaaagatgctgtccttggcggaacagcagctggtggactgcgcccaggacttcaataatyacggctgccaagggggtctccccagccaggctttcgagtatatcctgtacaacaaggggatcatgggtgaagacacctacccctaccagggcaaggatgg

SEQ ID NO: 9538 - DNA, 184 bp, Homo sapiens
gtgccttagtgtccttcttaacagactcaaaccacatggaccacgaatattctttctgtccagaagggctactttccacatatagagctccagggactgtyttttctgtattcgctgttcaataaacattgagtgagcacctccccagatggagcatgctggtcctgggccatgactcaaacca

SEQ ID NO: 9539 - DNA, 197 bp, Homo sapiens
tccacgctcgtgccgcccccccccgcgctcccagttgacgctctgggccgccacctccgcggaccctgagcgcaagagccaagccgccagcgctgckatgtgggccacgctgccgctgctctgcgccggggcctggctcctgggagtccccgtctgcggtgccgccgaactgtgcgtgaactccttagagaagtttc

SEQ ID NO: 9540 - DNA, 201 bp, Homo sapiens
aagagccaagccgccagcgctgcgatgtgggccacgctgccgctgctctgcgccggggcctggctcctgggagtccccgtctgcggtgccgccgaactgtscgtgaactccttagagaagtttcacttcaagtcatggatgtctaagcaccgtaagacctacagtacggaggagtaccaccacaggctgcagacgtttgcc

SEQ ID NO: 9541 - DNA, 201 bp, Homo sapiens
aggaggagttccaccatgagctcacccgtgtctatgacgcaaagatcaccagccatgtgccttagtgtccttcttaacagactcaaaccacatggaccacraatattctttctgtccagaagggctactttccacatatagagctccagggactgtcttttctgtattcgctgttcaataaacattgagtgagcacctccc

SEQ ID NO: 9542 - DNA, 201 bp, Homo sapiens
cctgccctggaggaagttgtggggagatccactgggacccccaacattctgccctcacctctgtgcccagcctggaaacctacagacaaggaggagttccmccatgagctcacccgtgtctatgacgcaaagatcaccagccatgtgccttagtgtccttcttaacagactcaaaccacatggaccacgaatattctttct

SEQ ID NO: 9543 - DNA, 201 bp, Homo sapiens
ccctgagcgcaagagccaagccgccagcgctgcgatgtgggccacgctgccgctgctctgcgccggggcctggctcctgggagtccccgtctgcggtgccrccgaactgtgcgtgaactccttagagaagtttcacttcaagtcatggatgtctaagcaccgtaagacctacagtacggaggagtaccaccacaggctgca

SEQ ID NO: 9544 - DNA, 201 bp, Homo sapiens
gtgaaaaatcagggtgcctgcggcagttgctggactttctccaccactggggccctggagtctgcgatcgccatcgcaaccggaaagatgctgtccttggsggaacagcagctggtggactgcgcccaggacttcaataatcacggctgccaagggggtctccccagccaggctttcgagtatatcctgtacaacaagggg

SEQ ID NO: 9545 - DNA, 201 bp, Homo sapiens
tggactggcggaaaaaaggaaattttgtctcacctgtgaaaaatcagggtgcctgcggcagttgctggactttctccaccactggggccctggagtctgcratcgccatcgcaaccggaaagatgctgtccttggcggaacagcagctggtggactgcgcccaggacttcaataatcacggctgccaagggggtctcccca

SEQ ID NO: 9546 - DNA, 201 bp, Homo sapiens
cggaaagaacatgtgtggcctggctgcctgcgcctcctaccccatccctctggtgtgagccgtggcagccgcagcgcagactggcggagaaggagaggaaygggcagcctgggcctgggtggaaatcctgccctggaggaagttgtggggagatccactgggacccccaacattctgccctcacctctgtgcccagcctgg

SEQ ID NO: 9547 - DNA, 201 bp, Homo sapiens
taccccatccctctggtgtgagccgtggcagccgcagcgcagactggcggagaaggagaggaacgggcagcctgggcctgggtggaaatcctgccctggargaagttgtggggagatccactgggacccccaacattctgccctcacctctgtgcccagcctggaaacctacagacaaggaggagttccaccatgagctca

SEQ ID NO: 9548 - DNA, 201 bp, Homo sapiens
ctcccagttgacgctctgggccgccacctccgcggaccctgagcgcaagagccaagccgccagcgctgcgatgtgggccacgctgccgctgctctgcgccrgggcctggctcctgggagtccccgtctgcggtgccgccgaactgtgcgtgaactccttagagaagtttcacttcaagtcatggatgtctaagcaccgtaa

SEQ ID NO: 9549 - DNA, 201 bp, Homo sapiens
tgggagtccccgtctgcggtgccgccgaactgtgcgtgaactccttagagaagtttcacttcaagtcatggatgtctaagcaccgtaagacctacagtacrgaggagtaccaccacaggctgcagacgtttgccagcaactggaggaagataaacgcccacaacaatgggaaccacacatttaaaatggcactgaaccaat

SEQ ID NO: 9550 - DNA, 201 bp, Homo sapiens
gaaatcctgccctggaggaagttgtggggagatccactgggacccccaacattctgccctcacctctgtgcccagcctggaaacctacagacaaggaggarttccaccatgagctcacccgtgtctatgacgcaaagatcaccagccatgtgccttagtgtccttcttaacagactcaaaccacatggaccacgaatattc

SEQ ID NO: 9551 - DNA, 201 bp, Homo sapiens
tcacaatctatgacgaggaagcgatggtggaggctgtggccctctacaaccctgtgagctttgcctttgaggtgactcaggacttcatgatgtatagaacsggcatctactccagtacttcctgccataaaactccagataaagtaaaccatgcagtactggctgttgggtatggagaaaaaaatgggatcccttactgga

SEQ ID NO: 9552 - DNA, 201 bp, Homo sapiens
atcgagcgcggaaagaacatgtgtggcctggctgcctgcgcctcctaccccatccctctggtgtgagccgtggcagccgcagcgcagactggcggagaagkagaggaacgggcagcctgggcctgggtggaaatcctgccctggaggaagttgtggggagatccactgggacccccaacattctgccctcacctctgtgcc

SEQ ID NO: 9553 - DNA, 201 bp, Homo sapiens
ctgtgcccagcctggaaacctacagacaaggaggagttccaccatgagctcacccgtgtctatgacgcaaagatcaccagccatgtgccttagtgtccttyttaacagactcaaaccacatggaccacgaatattctttctgtccagaagggctactttccacatatagagctccagggactgtcttttctgtattcgctg

SEQ ID NO: 9554 - DNA, 201 bp, Homo sapiens
atccactgggacccccaacattctgccctcacctctgtgcccagcctggaaacctacagacaaggaggagttccaccatgagctcacccgtgtctatgacrcaaagatcaccagccatgtgccttagtgtccttcttaacagactcaaaccacatggaccacgaatattctttctgtccagaagggctactttccacatat

SEQ ID NO: 9555 - DNA, 201 bp, Homo sapiens
tgtgccttccagcctcagctgggccccaagtgctgaacagtggctgcctgggaccagagctgatgaaggcagccccgtggagcccagccaagagcaggacrtcctaaccagcatggaggcctctggccacctcagcacaaatctctggcatgctgtcactgatgatgacacaggtcagaaagaaatacccatttctgaacg

SEQ ID NO: 9556 - DNA, 201 bp, Homo sapiens
ggtacgaagccctgccccaggcagtgtttgtggccctgagcgatgacacggcctggatcatcaggaccagtggggacctatacttgcagacaggtctgagygtggatcgcccttgtgccagagccgtaaaggtggactgtccctacccgctgtcccagatcacagcccggaacaatgtggtgtgggcgctgacagagcaga

SEQ ID NO: 9557 - DNA, 201 bp, Homo sapiens
tgtcgatgacctcaagtgtcctgggcagtagcgtggatcagttaagtgcagagtctccagaccaggaaagcagcttcaatggtgaagtgaacggtgtcccrcaggaaaatactgaccccgaaacgtttaatgtcctggaggtgtcaggatcaatgcctgattctctggctgaggaagatgacattagaactgaaatgccac

SEQ ID NO: 9558 - DNA, 201 bp, Homo sapiens
attaacatcaacagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 9559 - DNA, 201 bp, Homo sapiens
agctggatgggctactcgggtcccggctatggcatcctcagcttggtggtctccgagaagtatatctggtgcctggactacaaaggcggcctgttctgcarcgcgttgccgggcgccgggctgcgctggcagaagtttgaagatgctgtccagcaggtggcagtctcgccctcaggagcccttctctggaagattgaacag

SEQ ID NO: 9560 - DNA, 201 bp, Homo sapiens
gaggcacctggggcttgtttcatgtttctttcaagaaggctgggtgctgagttggaatgaatatagtatctatctcctagacacagtcaaccaggccacarttgctggtttggaaggatccggtgatattgtgtctgtttcgtgcacagaaaatgaaatatttttcttgaaaggagataggaacattataagaatttcaag

SEQ ID NO: 9561 - DNA, 201 bp, Homo sapiens
tgttggcttctgcagctcccacgaaggaaggaagcttcctgtggctgtgccagagcagcaaggacctgtgcagcgtcagcgcccagagcgcacagtcgcgrccctccacggtgcagctgcctcccgaagccgagatgcgcgcctatgccgcctgccaggatgcgctgtgggcgctggacagcctcggccaggtgttcatca

SEQ ID NO: 9562 - DNA, 201 bp, Homo sapiens
tctgtaaggcaaattggaacacaaccaaggaaaagtactgggaaatttggtgcttgttttataccaggactctgtaagcaaagtgatctaaccttgtatgygtcacggcccgggctccggctatggaaggctgatgtccacgggactgttcaagccacgtttatcttaaaagatgcttttgccgggggagtcaagcctttt

SEQ ID NO: 9563 - DNA, 201 bp, Homo sapiens
tcctccggcccggcggggccgacgagtccggaggggctgccgcgggagcccccaggtttccctagatgacaaataaacattccttttcctgcgtgaagatmgtctgtggaaaccttggccatggcatcgatatcagagcctgttacattcagagagttctgcccgttgtactatctcctcaatgccattccgacaaagatc

SEQ ID NO: 9564 - DNA, 201 bp, Homo sapiens
gtgggcgctgacagagcagagggccctcctgtaccgggagggcgtgagcagcttctgtccggaaggcgagcagtggaagtgtgacattgtcagcgaaaggmaagctttagaacccgtctgcataacgctcggggatcagcagactctctgggccctggacatccatgggaacctgtggttcagaactggcattatttccaa

SEQ ID NO: 9565 - DNA, 201 bp, Homo sapiens
cgtcacggcccgggctccggctatggaaggctgatgtccacgggactgttcaagccacgtttatcttaaaagatgcttttgccgggggagtcaagcctttwgaactgcacccgcgtctggaatcccccaacagtggaagttgcagcttacctgagaggcacctggggcttgtttcatgtttctttcaagaaggctgggtgc

SEQ ID NO: 9566 - DNA, 201 bp, Homo sapiens
cggtctctgccttggcagccagcactcacaagccctggcttgagcagcctccacgggatcagacattgacgtccagcgatgaggaggacatctatgcccaygggcttccttcttcatcctcagagacgagtgtgacagagctcggacctagttgctcccagcaggacctgagccggctgggtgcagaggacgccgggctgc

SEQ ID NO: 9567 - DNA, 201 bp, Homo sapiens
gaggcagtgatgtcacgggactcggagatgagccgtgtcctgcagatgatggaccaaatagcacacagttacccttccaagaacaggacagctctcctggrgcgcatgatggggaagacatccaacccattggcccccaaagcactttttgtgaagtccccctcctgaactcactcactgtgccttccagcctcagctggg

SEQ ID NO: 9568 - DNA, 201 bp, Homo sapiens
ccagctccgtggccagcgagccaaggagcaggagcagctcgctcaactccaccgacagcggctccgggctcctgccccctgggctccaggccacccctgarctgggcaagggcagccagcccctgtcacagagattcaacgccatcagctcagaggactttgaccaggagcttgtcgtgaagcctatcaaagtgaaaagga

SEQ ID NO: 9569 - DNA, 201 bp, Homo sapiens
ccgacgagtccggaggggctgccgcgggagcccccaggtttccctagatgacaaataaacattccttttcctgcgtgaagatagtctgtggaaaccttggycatggcatcgatatcagagcctgttacattcagagagttctgcccgttgtactatctcctcaatgccattccgacaaagatccagaagggtttccgctct

SEQ ID NO: 9570 - DNA, 201 bp, Homo sapiens
gccaaggagcaggagcagctcgctcaactccaccgacagcggctccgggctcctgccccctgggctccaggccacccctgagctgggcaagggcagccagyccctgtcacagagattcaacgccatcagctcagaggactttgaccaggagcttgtcgtgaagcctatcaaagtgaaaaggaagaagaagaagaagaagac

SEQ ID NO: 9571 - DNA, 201 bp, Homo sapiens; identical to SEQ ID NO: 9555

SEQ ID NO: 9572 - DNA, 201 bp, Homo sapiens
gtagccgggcagctggtttggcccagggcctccttccacattagtagccccagggccagatggagccaaaggtcagctctctgcagcgcgggatgtgctcrgtgatggctttgtcccatcataggggggtgtccccccagagacaaagctgcagagcacattccatgccagacgctctggccaggaagctgaggccgggct

SEQ ID NO: 9573 - DNA, 201 bp, Homo sapiens; identical to SEQ ID NO: 9556

SEQ ID NO: 9574 - DNA, 201 bp, Homo sapiens
cgagtgggaggtcatctgaaggagccctggccgagtcacgcggaggggcccggcgtctgtggcgggcacaggggcttcggagtgactccctggtggacgcrctgcctcaacacttgtccagacacctctggccaggttggacccgcacacttactttcatctatgttggtttctgtctcgttccagaacccacagcctcca

SEQ ID NO: 9575 - DNA, 201 bp, Homo sapiens
cctcaacacttgtccagacacctctggccaggttggacccgcacacttactttcatctatgttggtttctgtctcgttccagaacccacagcctccacccrtggctggcgtgattgctgcagcagtggcgcctcctagctcaggacagtggcgactgcccggctgcatgcactccgattacccacgtgctgccgtcctggt

SEQ ID NO: 9576 - DNA, 201 bp, Homo sapiens
ccgcaccgcaccgcaccgtacctcgccacatctcaccacaccacaccacaccacacctcactgcccacacacggcgcaggctgcccgcctcctggagagcrcacttcagctgaaacagtaaagcctgatgggtgcaaatggaacctggatgtgtgcacgtgtgtcccaggtagggacggcacaggagggtgcatggggcgt

SEQ ID NO: 9577 - DNA, 201 bp, Homo sapiens; identical to SEQ ID NO: 9557

SEQ ID NO: 9578 - DNA, 201 bp, Homo sapiens
gcaccgcaccgcaccgtacctcgccacatctcaccacaccacaccacaccacacctcactgcccacacacggcgcaggctgcccgcctcctggagagcacwcttcagctgaaacagtaaagcctgatgggtgcaaatggaacctggatgtgtgcacgtgtgtcccaggtagggacggcacaggagggtgcatggggcgtgg

SEQ ID NO: 9579 - DNA, 201 bp, Homo sapiens
aagcaggcctgaaggattaacatcaacagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 9580 - DNA, 201 bp, Homo sapiens; identical to SEQ ID NO: 9559

SEQ ID NO: 9581 - DNA, 201 bp, Homo sapiens; identical to SEQ ID NO: 9560

SEQ ID NO: 9582 - DNA, 201 bp, Homo sapiens; identical to SEQ ID NO: 9561

SEQ ID NO: 9583 - DNA, 201 bp, Homo sapiens; identical to SEQ ID NO: 9562

SEQ ID NO: 9584 - DNA, 201 bp, Homo sapiens
cccaccctgaggacctggaggacgagtgggaggtcatctgaaggagccctggccgagtcacgcggaggggcccggcgtctgtggcgggcacaggggcttcrgagtgactccctggtggacgcgctgcctcaacacttgtccagacacctctggccaggttggacccgcacacttactttcatctatgttggtttctgtctc

SEQ ID NO: 9585 - DNA, 201 bp, Homo sapiens; identical to SEQ ID NO: 9563

SEQ ID NO: 9586 - DNA, 201 bp, Homo sapiens; identical to SEQ ID NO: 9564

SEQ ID NO: 9587 - DNA, 201 bp, Homo sapiens; identical to SEQ ID NO: 9565

SEQ ID NO: 9588 - DNA, 201 bp, Homo sapiens; identical to SEQ ID NO: 9566

SEQ ID NO: 9589 - DNA, 201 bp, Homo sapiens
ctgcataaaatacctcatttcaaatcaaatcttacaaatttagaagagagatatgttttccgaaaacagtggaagccctttgttccttcccgggtttgtcytgagcctgcactgtcctcgcctgcagcctcagaggggcaggcatccccgcacagacttgactggcagggcggtcacgggacctgcgggctggctccgagt

SEQ ID NO: 9590 - DNA, 201 bp, Homo sapiens
ttccttcccgggtttgtcctgagcctgcactgtcctcgcctgcagcctcagaggggcaggcatccccgcacagacttgactggcagggcggtcacgggacytgcgggctggctccgagtggcagcccatgccttctgcggggtatgggttgacacttgacaggttgaaaccagtgcctctatggacggctgctgtggcccc

SEQ ID NO: 9591 - DNA, 201 bp, Homo sapiens
cacttgacaggttgaaaccagtgcctctatggacggctgctgtggccccttcagacaatgggcagtgcccaccccgcccactggcatctgcgtgtgagggmtaggccgccctgccacacatcccgccccctcccggaggcagcttcaggacaggacaccaggctggctgctttttttagcctgcccctggcccaggcccag

SEQ ID NO: 9592 - DNA, 201 bp, Homo sapiens
tgggaggtcatctgaaggagccctggccgagtcacgcggaggggcccggcgtctgtggcgggcacaggggcttcggagtgactccctggtggacgcgctgyctcaacacttgtccagacacctctggccaggttggacccgcacacttactttcatctatgttggtttctgtctcgttccagaacccacagcctccacccg

SEQ ID NO: 9593 - DNA, 201 bp, Homo sapiens
aaaatacctcatttcaaatcaaatcttacaaatttagaagagagatatgttttccgaaaacagtggaagccctttgttccttcccgggtttgtcctgagcytgcactgtcctcgcctgcagcctcagaggggcaggcatccccgcacagacttgactggcagggcggtcacgggacctgcgggctggctccgagtggcagc

SEQ ID NO: 9594 - DNA, 201 bp, Homo sapiens; identical to SEQ ID NO: 9567

SEQ ID NO: 9595 - DNA, 201 bp, Homo sapiens
ttcaaatcaaatcttacaaatttagaagagagatatgttttccgaaaacagtggaagccctttgttccttcccgggtttgtcctgagcctgcactgtcctygcctgcagcctcagaggggcaggcatccccgcacagacttgactggcagggcggtcacgggacctgcgggctggctccgagtggcagcccatgccttctg

SEQ ID NO: 9596 - DNA, 201 bp, Homo sapiens; identical to SEQ ID NO: 9568

SEQ ID NO: 9597 - DNA, 201 bp, Homo sapiens; identical to SEQ ID NO: 9569

SEQ ID NO: 9598 - DNA, 201 bp, Homo sapiens
cctgcagcctcagaggggcaggcatccccgcacagacttgactggcagggcggtcacgggacctgcgggctggctccgagtggcagcccatgccttctgcrgggtatgggttgacacttgacaggttgaaaccagtgcctctatggacggctgctgtggccccttcagacaatgggcagtgcccaccccgcccactggcat

SEQ ID NO: 9599 - DNA, 201 bp, Homo sapiens; identical to SEQ ID NO: 9570

SEQ ID NO: 9600 - DNA, 201 bp, Homo sapiens
cggggtatgggttgacacttgacaggttgaaaccagtgcctctatggacggctgctgtggccccttcagacaatgggcagtgcccaccccgcccactggcrtctgcgtgtgagggctaggccgccctgccacacatcccgccccctcccggaggcagcttcaggacaggacaccaggctggctgctttttttagcctgccc

SEQ ID NO: 9601 - DNA, 201 bp, Homo sapiens; identical to SEQ ID NO: 9555

SEQ ID NO: 9602 - DNA, 201 bp, Homo sapiens; identical to SEQ ID NO: 9572

SEQ ID NO: 9603 - DNA, 201 bp, Homo sapiens; identical to SEQ ID NO: 9556

SEQ ID NO: 9604 - DNA, 201 bp, Homo sapiens; identical to SEQ ID NO: 9574

SEQ ID NO: 9605 - DNA, 201 bp, Homo sapiens; identical to SEQ ID NO: 9575

SEQ ID NO: 9606 - DNA, 201 bp, Homo sapiens; identical to SEQ ID NO: 9576

SEQ ID NO: 9607 - DNA, 201 bp, Homo sapiens; identical to SEQ ID NO: 9557

SEQ ID NO: 9608 - DNA, 201 bp, Homo sapiens; identical to SEQ ID NO: 9578

SEQ ID NO: 9609 - DNA, 201 bp, Homo sapiens; identical to SEQ ID NO: 9579

SEQ ID NO: 9610 - DNA, 201 bp, Homo sapiens; identical to SEQ ID NO: 9559

SEQ ID NO: 9611 - DNA, 201 bp, Homo sapiens; identical to SEQ ID NO: 9560

SEQ ID NO: 9612 - DNA, 201 bp, Homo sapiens; identical to SEQ ID NO: 9561

SEQ ID NO: 9613 - DNA, 201 bp, Homo sapiens; identical to SEQ ID NO: 9562

SEQ ID NO: 9614 - DNA, 201 bp, Homo sapiens; identical to SEQ ID NO: 9584

SEQ ID NO: 9615 - DNA, 201 bp, Homo sapiens; identical to SEQ ID NO: 9563

SEQ ID NO: 9616 - DNA, 201 bp, Homo sapiens; identical to SEQ ID NO: 9564

SEQ ID NO: 9617 - DNA, 201 bp, Homo sapiens; identical to SEQ ID NO: 9565

SEQ ID NO: 9618 - DNA, 201 bp, Homo sapiens; identical to SEQ ID NO: 9566

SEQ ID NO: 9619 - DNA, 201 bp, Homo sapiens; identical to SEQ ID NO: 9589

SEQ ID NO: 9620 - DNA, 201 bp, Homo sapiens; identical to SEQ ID NO: 9590

SEQ ID NO: 9621 - DNA, 201 bp, Homo sapiens; identical to SEQ ID NO: 9591

SEQ ID NO: 9622 - DNA, 201 bp, Homo sapiens; identical to SEQ ID NO: 9592

SEQ ID NO: 9623 - DNA, 201 bp, Homo sapiens; identical to SEQ ID NO: 9593

SEQ ID NO: 9624 - DNA, 201 bp, Homo sapiens; identical to SEQ ID NO: 9567

SEQ ID NO: 9625 - DNA, 201 bp, Homo sapiens; identical to SEQ ID NO: 9595

SEQ ID NO: 9626 - DNA, 201 bp, Homo sapiens; identical to SEQ ID NO: 9568

SEQ ID NO: 9627 - DNA, 201 bp, Homo sapiens; identical to SEQ ID NO: 9569

SEQ ID NO: 9628 - DNA, 201 bp, Homo sapiens; identical to SEQ ID NO: 9598

SEQ ID NO: 9629 - DNA, 201 bp, Homo sapiens; identical to SEQ ID NO: 9570

SEQ ID NO: 9630 - DNA, 201 bp, Homo sapiens; identical to SEQ ID NO: 9600

SEQ ID NO: 9631 - DNA, 201 bp, Homo sapiens; identical to SEQ ID NO: 9555

SEQ ID NO: 9632 - DNA, 201 bp, Homo sapiens; identical to SEQ ID NO: 9572

SEQ ID NO: 9633 - DNA, 201 bp, Homo sapiens; identical to SEQ ID NO: 9556

SEQ ID NO: 9634 - DNA, 201 bp, Homo sapiens; identical to SEQ ID NO: 9574

SEQ ID NO: 9635 - DNA, 201 bp, Homo sapiens; identical to SEQ ID NO: 9575

SEQ ID NO: 9636 - DNA, 201 bp, Homo sapiens; identical to SEQ ID NO: 9576

SEQ ID NO: 9637 - DNA, 201 bp, Homo sapiens; identical to SEQ ID NO: 9557

SEQ ID NO: 9638 - DNA, 201 bp, Homo sapiens; identical to SEQ ID NO: 9578

SEQ ID NO: 9639 - DNA, 201 bp, Homo sapiens; identical to SEQ ID NO: 9579

SEQ ID NO: 9640 - DNA, 201 bp, Homo sapiens; identical to SEQ ID NO: 9559

SEQ ID NO: 9641 - DNA, 201 bp, Homo sapiens; identical to SEQ ID NO: 9560

SEQ ID NO: 9642 - DNA, 201 bp, Homo sapiens; identical to SEQ ID NO: 9561

SEQ ID NO: 9643 - DNA, 201 bp, Homo sapiens; identical to SEQ ID NO: 9562

SEQ ID NO: 9644 - DNA, 201 bp, Homo sapiens; identical to SEQ ID NO: 9584

SEQ ID NO: 9645 - DNA, 201 bp, Homo sapiens; identical to SEQ ID NO: 9563

SEQ ID NO: 9646 - DNA, 201 bp, Homo sapiens; identical to SEQ ID NO: 9564

SEQ ID NO: 9647 - DNA, 201 bp, Homo sapiens; identical to SEQ ID NO: 9565

SEQ ID NO: 9648 - DNA, 201 bp, Homo sapiens; identical to SEQ ID NO: 9566

SEQ ID NO: 9649 - DNA, 201 bp, Homo sapiens; identical to SEQ ID NO: 9589

SEQ ID NO: 9650 - DNA, 201 bp, Homo sapiens; identical to SEQ ID NO: 9590

SEQ ID NO: 9651 - DNA, 201 bp, Homo sapiens; identical to SEQ ID NO: 9591

SEQ ID NO: 9652 - DNA, 201 bp, Homo sapiens; identical to SEQ ID NO: 9592

SEQ ID NO: 9653 - DNA, 201 bp, Homo sapiens; identical to SEQ ID NO: 9593

SEQ ID NO: 9654 - DNA, 201 bp, Homo sapiens; identical to SEQ ID NO: 9567

SEQ ID NO: 9655 - DNA, 201 bp, Homo sapiens; identical to SEQ ID NO: 9595

SEQ ID NO: 9656 - DNA, 201 bp, Homo sapiens; identical to SEQ ID NO: 9568

SEQ ID NO: 9657 - DNA, 201 bp, Homo sapiens; identical to SEQ ID NO: 9569

SEQ ID NO: 9658 - DNA, 201 bp, Homo sapiens; identical to SEQ ID NO: 9598

SEQ ID NO: 9659 - DNA, 201 bp, Homo sapiens; identical to SEQ ID NO: 9570

SEQ ID NO: 9660 - DNA, 201 bp, Homo sapiens; identical to SEQ ID NO: 9600

SEQ ID NO: 9661 - DNA, 201 bp, Homo sapiens
ctactgcccctcgctaggaatatgggcctcgcaggtcggcagcgtgaggtcctctgtgccaccttccatcagtaggaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 9662 - DNA, 201 bp, Homo sapiens
gtggcctggagaccatcctgcacatgacctgctgccgtcagcgcctggaggagatcacgggccatctgcacaaagctaagcagctgggcctgaagaacatsatggcgctgcggggagacccaataggtgaccagtgggaagaggaggagggaggcttcaactacgcagtggacctggtgaagcacatccgaagtgagtttg

SEQ ID NO: 9663 - DNA, 158 bp, Homo sapiens
gaccatcgaaaagccagggtcctcccagctgggcactactgcccctcgctaggaataygggcctcgcaggtcggcagcgtgaggtcctctgtgccaccttccatcagtaggaacccagccatggtgaacgaagccagaggaaacagcagcctcaaccc

SEQ ID NO: 9664 - DNA, 201 bp, Homo sapiens
acgtgattgagccaatcaaagacaacgatgctgccatccgcaactatggcatcgagctggccgtgagcctgtgccaggagcttctggccagtggcttggtrccaggcctccacttctacaccctcaaccgcgagatggctaccacagaggtgctgaagcgcctggggatgtggactgaggaccccaggcgtcccctaccct

SEQ ID NO: 9665 - DNA, 201 bp, Homo sapiens
gccagcagtggcagtgagagctccaaagatagttcgagatgttccaccccgggcctggaccccgagcggcatgagagactccgggagaagatgaggcggcrattggaatctggtgacaagtggttctccctggaattcttccctcctcgaactgctgagggagctgtcaatctcatctcaaggtttgaccggatggcagca

SEQ ID NO: 9666 - DNA, 201 bp, Homo sapiens
caccccaagcgccgagaggaagatgtacgtcccatcttctgggcctccagaccaaagagttacatctaccgtacccaggagtgggacgagttccctaacgrccgctggggcaattcctcttcccctgcctttggggagctgaaggactactacctcttctacctgaagagcaagtcccccaaggaggagctgctgaagatg

SEQ ID NO: 9667 - DNA, 201 bp, Homo sapiens
actactacctcttctacctgaagagcaagtcccccaaggaggagctgctgaagatgtggggggaggagctgaccagtgaagaaagtgtctttgaagtcttygttctttacctctcgggagaaccaaaccggaatggtcacaaagtgacttgcctgccctggaacgatgagcccctggcggctgagaccagcctgctgaagg

SEQ ID NO: 9668 - DNA, 201 bp, Homo sapiens
gcctttggggagctgaaggactactacctcttctacctgaagagcaagtcccccaaggaggagctgctgaagatgtggggggaggagctgaccagtgaagmaagtgtctttgaagtctttgttctttacctctcgggagaaccaaaccggaatggtcacaaagtgacttgcctgccctggaacgatgagcccctggcggct

SEQ ID NO: 9669 - DNA, 201 bp, Homo sapiens
gcaattcctcttcccctgcctttggggagctgaaggactactacctcttctacctgaagagcaagtcccccaaggaggagctgctgaagatgtggggggakgagctgaccagtgaagaaagtgtctttgaagtctttgttctttacctctcgggagaaccaaaccggaatggtcacaaagtgacttgcctgccctggaacg

SEQ ID NO: 9670 - DNA, 201 bp, Homo sapiens
gatggcagcaggtggccccctctacatagacgtgacctggcacccagcaggtgaccctggctcagacaaggagacctcctccatgatgatcgccagcaccrccgtgaactactgtggcctggagaccatcctgcacatgacctgctgccgtcagcgcctggaggagatcacgggccatctgcacaaagctaagcagctggg

SEQ ID NO: 9671 - DNA, 201 bp, Homo sapiens
tgaactgcagccgaatgctgtcacttggggcatcttccctgggcgagagatcatccagcccaccgtagtggatcccgtcagcttcatgttctggaaggacraggcctttgccctgtggattgagcggtggggaaagctgtatgaggaggagtccccgtcccgcaccatcatccagtacatccacgacaactacttcctggt

SEQ ID NO: 9672 - DNA, 201 bp, Homo sapiens
ccgcgagatggctaccacagaggtgctgaagcgcctggggatgtggactgaggaccccaggcgtcccctaccctgggctctcagcgcccaccccaagcgcygagaggaagatgtacgtcccatcttctgggcctccagaccaaagagttacatctaccgtacccaggagtgggacgagttccctaacggccgctggggcaa

SEQ ID NO: 9673 - DNA, 201 bp, Homo sapiens
ggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggagggggct

SEQ ID NO: 9674 - DNA, 201 bp, Homo sapiens
aggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggagggggc

SEQ ID NO: 9675 - DNA, 201 bp, Homo sapiens
gaggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggaggggg

SEQ ID NO: 9676 - DNA, 201 bp, Homo sapiens
gaggaaacagcagcctcaacccctgcttggagggcagtgccagcagtggcagtgagagctccaaagatagttcgagatgttccaccccgggcctggacccygagcggcatgagagactccgggagaagatgaggcggcgattggaatctggtgacaagtggttctccctggaattcttccctcctcgaactgctgagggag

SEQ ID NO: 9677 - DNA, 201 bp, Homo sapiens
tgtgtggcaggttaccccaaaggccaccccgaagcagggagctttgaggctgacctgaagcacttgaaggagaaggtgtctgcgggagccgatttcatcaycacgcagcttttctttgaggctgacacattcttccgctttgtgaaggcatgcaccgacatgggcatcacttgccccatcgtccccgggatctttcccatc

SEQ ID NO: 9678 - DNA, 201 bp, Homo sapiens
acttctacaccctcaaccgcgagatggctaccacagaggtgctgaagcgcctggggatgtggactgaggaccccaggcgtcccctaccctgggctctcagygcccaccccaagcgccgagaggaagatgtacgtcccatcttctgggcctccagaccaaagagttacatctaccgtacccaggagtgggacgagttcccta

SEQ ID NO: 9679 - DNA, 201 bp, Homo sapiens
aagcagggagctttgaggctgacctgaagcacttgaaggagaaggtgtctgcgggagccgatttcatcatcacgcagcttttctttgaggctgacacattyttccgctttgtgaaggcatgcaccgacatgggcatcacttgccccatcgtccccgggatctttcccatccagggctaccactcccttcggcagcttgtga

SEQ ID NO: 9680 - DNA, 201 bp, Homo sapiens
tactttgacatctgtgtggcaggttaccccaaaggccaccccgaagcagggagctttgaggctgacctgaagcacttgaaggagaaggtgtctgcgggagycgatttcatcatcacgcagcttttctttgaggctgacacattcttccgctttgtgaaggcatgcaccgacatgggcatcacttgccccatcgtccccggg

SEQ ID NO: 9681 - DNA, 201 bp, Homo sapiens
tggggcatcttccctgggcgagagatcatccagcccaccgtagtggatcccgtcagcttcatgttctggaaggacgaggcctttgccctgtggattgagcrgtggggaaagctgtatgaggaggagtccccgtcccgcaccatcatccagtacatccacgacaactacttcctggtcaacctggtggacaatgacttccca

SEQ ID NO: 9682 - DNA, 201 bp, Homo sapiens
gagctccgggttaattaccaccttgtcaatgtgaagggtgaaaacatcaccaatgcccctgaactgcagccgaatgctgtcacttggggcatcttccctgrgcgagagatcatccagcccaccgtagtggatcccgtcagcttcatgttctggaaggacgaggcctttgccctgtggattgagcggtggggaaagctgtat

SEQ ID NO: 9683 - DNA, 201 bp, Homo sapiens
agggaggcttcaactacgcagtggacctggtgaagcacatccgaagtgagtttggtgactactttgacatctgtgtggcaggttaccccaaaggccacccygaagcagggagctttgaggctgacctgaagcacttgaaggagaaggtgtctgcgggagccgatttcatcatcacgcagcttttctttgaggctgacacat

SEQ ID NO: 9684 - DNA, 201 bp, Homo sapiens
gctccgggttaattaccaccttgtcaatgtgaagggtgaaaacatcaccaatgcccctgaactgcagccgaatgctgtcacttggggcatcttccctgggygagagatcatccagcccaccgtagtggatcccgtcagcttcatgttctggaaggacgaggcctttgccctgtggattgagcggtggggaaagctgtatga

SEQ ID NO: 9685 - DNA, 201 bp, Homo sapiens
gtggcaggttaccccaaaggccaccccgaagcagggagctttgaggctgacctgaagcacttgaaggagaaggtgtctgcgggagccgatttcatcatcaygcagcttttctttgaggctgacacattcttccgctttgtgaaggcatgcaccgacatgggcatcacttgccccatcgtccccgggatctttcccatccag

SEQ ID NO: 9686 - DNA, 201 bp, Homo sapiens
accatcctgcacatgacctgctgccgtcagcgcctggaggagatcacgggccatctgcacaaagctaagcagctgggcctgaagaacatcatggcgctgcrgggagacccaataggtgaccagtgggaagaggaggagggaggcttcaactacgcagtggacctggtgaagcacatccgaagtgagtttggtgactacttt

SEQ ID NO: 9687 - DNA, 103 bp, Homo sapiens
gamcatcgaaaagccagggtcctcccagctgggcactactgcccctcgctaggaatatgggcctcgcaggtcggcagcgtgaggtcctctgtgccaccttcca

SEQ ID NO: 9688 - DNA, 201 bp, Homo sapiens
gatgctgccatccgcaactatggcatcgagctggccgtgagcctgtgccaggagcttctggccagtggcttggtgccaggcctccacttctacaccctcarccgcgagatggctaccacagaggtgctgaagcgcctggggatgtggactgaggaccccaggcgtcccctaccctgggctctcagcgcccaccccaagcgc

SEQ ID NO: 9689 - DNA, 201 bp, Homo sapiens
tgcccctgaactgcagccgaatgctgtcacttggggcatcttccctgggcgagagatcatccagcccaccgtagtggatcccgtcagcttcatgttctggwaggacgaggcctttgccctgtggattgagcggtggggaaagctgtatgaggaggagtccccgtcccgcaccatcatccagtacatccacgacaactactt

SEQ ID NO: 9690 - DNA, 187 bp, Homo sapiens
aaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccg

SEQ ID NO: 9691 - DNA, 201 bp, Homo sapiens
aggaccccaggcgtcccctaccctgggctctcagcgcccaccccaagcgccgagaggaagatgtacgtcccatcttctgggcctccagaccaaagagttasatctaccgtacccaggagtgggacgagttccctaacggccgctggggcaattcctcttcccctgcctttggggagctgaaggactactacctcttctacc

SEQ ID NO: 9692 - DNA, 201 bp, Homo sapiens
agtgccagcagtggcagtgagagctccaaagatagttcgagatgttccaccccgggcctggaccccgagcggcatgagagactccgggagaagatgaggcsgcgattggaatctggtgacaagtggttctccctggaattcttccctcctcgaactgctgagggagctgtcaatctcatctcaaggtttgaccggatggca

SEQ ID NO: 9693 - DNA, 201 bp, Homo sapiens
aacgatgctgccatccgcaactatggcatcgagctggccgtgagcctgtgccaggagcttctggccagtggcttggtgccaggcctccacttctacacccycaaccgcgagatggctaccacagaggtgctgaagcgcctggggatgtggactgaggaccccaggcgtcccctaccctgggctctcagcgcccaccccaag

SEQ ID NO: 9694 - DNA, 112 bp, Homo sapiens
ccaatgctttgggaggccaaggcaggtagatcgcttgagcccaggagtttgagacaagccctggcaacatagtgagatcccatttctacaaaaaaaaaaaaaaaattagccg

SEQ ID NO: 9695 - DNA, 201 bp, Homo sapiens
ccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggcctacttagagtttttcacttcccgcgagacagcggaagcacttc

SEQ ID NO: 9696 - DNA, 201 bp, Homo sapiens
aacctggtggacaatgacttcccactggacaactgcctctggcaggtggtggaagacacattggagcttctcaacaggcccacccagaatgcgagagaaayggaggctccatgaccctgcgtcctgacgccctgcgttggagccactcctgtcccgccttcctcctccacagtgctgcttctcttgggaactccactctcc

SEQ ID NO: 9697 - DNA, 201 bp, Homo sapiens
tgctgccatccgcaactatggcatcgagctggccgtgagcctgtgccaggagcttctggccagtggcttggtgccaggcctccacttctacaccctcaacygcgagatggctaccacagaggtgctgaagcgcctggggatgtggactgaggaccccaggcgtcccctaccctgggctctcagcgcccaccccaagcgccg

SEQ ID NO: 9698 - DNA, 113 bp, Homo sapiens
cccaatgctttgggaggccaaggcaggtagatcgcttgagcccaggagtttgagacaagccctggcaacatagtgagatcccatttctacaaaaaaaaaaaaaaaattagccg

SEQ ID NO: 9699 - DNA, 201 bp, Homo sapiens
ggtggcacctcctgagaaggcgaggagagtggttgttgccaactaagccctcgaaccaaggcagcctccagagccagcctgggactcccagtgaacttacmcttggagcccgtgcagtacaggcaaaacacgcaagggcatcaggcactggtggcatcgtagaagagatgtggcaaagtgctgtacccttccacctcctag

SEQ ID NO: 9700 - DNA, 201 bp, Homo sapiens
agacctcctccatgatgatcgccagcaccgccgtgaactactgtggcctggagaccatcctgcacatgacctgctgccgtcagcgcctggaggagatcacrggccatctgcacaaagctaagcagctgggcctgaagaacatcatggcgctgcggggagacccaataggtgaccagtgggaagaggaggagggaggcttca

SEQ ID NO: 9701 - DNA, 201 bp, Homo sapiens
ggatggcagcaggtggccccctctacatagacgtgacctggcacccagcaggtgaccctggctcagacaaggagacctcctccatgatgatcgccagcacmgccgtgaactactgtggcctggagaccatcctgcacatgacctgctgccgtcagcgcctggaggagatcacgggccatctgcacaaagctaagcagctgg

SEQ ID NO: 9702 - DNA, 201 bp, Homo sapiens
ccgggcctggaccccgagcggcatgagagactccgggagaagatgaggcggcgattggaatctggtgacaagtggttctccctggaattcttccctcctcraactgctgagggagctgtcaatctcatctcaaggtttgaccggatggcagcaggtggccccctctacatagacgtgacctggcacccagcaggtgaccct

SEQ ID NO: 9703 - DNA, 201 bp, Homo sapiens
tgaagctgtccaagctggaggtgccacaggagatcaaggacgtgattgagccaatcaaagacaacgatgctgccatccgcaactatggcatcgagctggcygtgagcctgtgccaggagcttctggccagtggcttggtgccaggcctccacttctacaccctcaaccgcgagatggctaccacagaggtgctgaagcgcc

SEQ ID NO: 9704 - DNA, 201 bp, Homo sapiens
cgctggggcaattcctcttcccctgcctttggggagctgaaggactactacctcttctacctgaagagcaagtcccccaaggaggagctgctgaagatgtrgggggaggagctgaccagtgaagaaagtgtctttgaagtctttgttctttacctctcgggagaaccaaaccggaatggtcacaaagtgacttgcctgccc

SEQ ID NO: 9705 - DNA, 201 bp, Homo sapiens
ccactcaggtgtcttgatgtgtcgggggtgtggctgcctgccccctgatgctccctgccccaccctgtgcagtaggaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 9706 - DNA, 201 bp, Homo sapiens; identical to SEQ ID NO: 9662

SEQ ID NO: 9707 - DNA, 201 bp, Homo sapiens; identical to SEQ ID NO: 9664

SEQ ID NO: 9708 - DNA, 201 bp, Homo sapiens; identical to SEQ ID NO: 9665

SEQ ID NO: 9709 - DNA, 201 bp, Homo sapiens; identical to SEQ ID NO: 9666

SEQ ID NO: 9710 - DNA, 201 bp, Homo sapiens; identical to SEQ ID NO: 9667

SEQ ID NO: 9711 - DNA, 201 bp, Homo sapiens; identical to SEQ ID NO: 9668

SEQ ID NO: 9712 - DNA, 201 bp, Homo sapiens; identical to SEQ ID NO: 9669

SEQ ID NO: 9713 - DNA, 201 bp, Homo sapiens; identical to SEQ ID NO: 9670

SEQ ID NO: 9714 - DNA, 201 bp, Homo sapiens; identical to SEQ ID NO: 9671

SEQ ID NO: 9715 - DNA, 201 bp, Homo sapiens; identical to SEQ ID NO: 9672

SEQ ID NO: 9716 - DNA, 201 bp, Homo sapiens; identical to SEQ ID NO: 9673

SEQ ID NO: 9717 - DNA, 201 bp, Homo sapiens; identical to SEQ ID NO: 9674

SEQ ID NO: 9718 - DNA, 201 bp, Homo sapiens; identical to SEQ ID NO: 9675

SEQ ID NO: 9719 - DNA, 201 bp, Homo sapiens; identical to SEQ ID NO: 9676

SEQ ID NO: 9720 - DNA, 201 bp, Homo sapiens; identical to SEQ ID NO: 9677

SEQ ID NO: 9721 - DNA, 201 bp, Homo sapiens; identical to SEQ ID NO: 9678

SEQ ID NO: 9722 - DNA, 201 bp, Homo sapiens; identical to SEQ ID NO: 9679

SEQ ID NO: 9723 - DNA, 201 bp, Homo sapiens; identical to SEQ ID NO: 9680

SEQ ID NO: 9724 - DNA, 201 bp, Homo sapiens; identical to SEQ ID NO: 9681

SEQ ID NO: 9725 - DNA, 201 bp, Homo sapiens; identical to SEQ ID NO: 9683

SEQ ID NO: 9726 - DNA, 201 bp, Homo sapiens; identical to SEQ ID NO: 9682

SEQ ID NO: 9727 - DNA, 201 bp, Homo sapiens; identical to SEQ ID NO: 9684

SEQ ID NO: 9728 - DNA, 201 bp, Homo sapiens; identical to SEQ ID NO: 9685

SEQ ID NO: 9729 - DNA, 201 bp, Homo sapiens; identical to SEQ ID NO: 9686

SEQ ID NO: 9730 - DNA, 201 bp, Homo sapiens; identical to SEQ ID NO: 9688

SEQ ID NO: 9731 - DNA, 201 bp, Homo sapiens; identical to SEQ ID NO: 9689

SEQ ID NO: 9732 - DNA, 187 bp, Homo sapiens; identical to SEQ ID NO: 9690

SEQ ID NO: 9733 - DNA, 201 bp, Homo sapiens; identical to SEQ ID NO: 9691

SEQ ID NO: 9734 - DNA, 201 bp, Homo sapiens; identical to SEQ ID NO: 9692

SEQ ID NO: 9735 - DNA, 201 bp, Homo sapiens; identical to SEQ ID NO: 9693

SEQ ID NO: 9736 - DNA, 112 bp, Homo sapiens; identical to SEQ ID NO: 9694

SEQ ID NO: 9737 - DNA, 201 bp, Homo sapiens; identical to SEQ ID NO: 9695

SEQ ID NO: 9738 - DNA, 201 bp, Homo sapiens; identical to SEQ ID NO: 9696

SEQ ID NO: 9739 - DNA, 201 bp, Homo sapiens; identical to SEQ ID NO: 9697

SEQ ID NO: 9740 - DNA, 113 bp, Homo sapiens; identical to SEQ ID NO: 9698

SEQ ID NO: 9741 - DNA, 201 bp, Homo sapiens; identical to SEQ ID NO: 9699

SEQ ID NO: 9742 - DNA, 201 bp, Homo sapiens; identical to SEQ ID NO: 9700

SEQ ID NO: 9743 - DNA, 179 bp, Homo sapiens
gccacagtggtgcggccggcggccgagcgttctgagtcacccgggactggagggccttcttcctgtgtggaaatacagygcctccggcttgaacctgccactcaggtgtcttgatgtgtcgggggtgtggctgcctgccccctgatgctccctgccccaccctgtgcagtaggaaccca

SEQ ID NO: 9744 - DNA, 201 bp, Homo sapiens; identical to SEQ ID NO: 9701

SEQ ID NO: 9745 - DNA, 201 bp, Homo sapiens; identical to SEQ ID NO: 9702

SEQ ID NO: 9746 - DNA, 201 bp, Homo sapiens; identical to SEQ ID NO: 9703

SEQ ID NO: 9747 - DNA, 201 bp, Homo sapiens; identical to SEQ ID NO: 9704

SEQ ID NO: 9748 - DNA, 201 bp, Homo sapiens
gtggtagaagaatctgcccgagcttctgtctcagttttgggagacatattaggctctgccatgcaaaacacacaaaatcttctccagatgccctatggctrtggagagcagaatatggtcctctttgctcctaacatctatgtactggattatctaaatgaaacacagcagcttactccagagatcaagtccaaggccatt

SEQ ID NO: 9749 - DNA, 173 bp, Homo sapiens
tgagtttgcaattgctgagtacaatgctccttgcagcaaagatcttggaaatgcttgaagaccacaaggctgaaaagtgctttgctggagtcctgttctcwgagctccacagaagacacgtgtttttgtatctttaaagacttgatgaataaacactttttctggtcaatgtc

SEQ ID NO: 9750 - DNA, 201 bp, Homo sapiens
cttcagggacattttccagcaaattccaagtggacaacaacaaccgcctgttactgcagcaggtctcattgccagagctgcctggggaatacagcatgaargtgacaggagaaggatgtgtctacctccagacatccttgaaatacaatattctcccagaaaaggaagagttcccctttgctttaggagtgcagactctgc

SEQ ID NO: 9751 - DNA, 201 bp, Homo sapiens
caagaagaaggaacagtggtggaattgactggaaggcagtccagtgaaatcacaagaaccataaccaaactctcatttgtgaaagtggactcacactttcracagggaattcccttctttgggcaggtgcgcctagtagatgggaaaggcgtccctataccaaataaagtcatattcatcagaggaaatgaagcaaactat

SEQ ID NO: 9752 - DNA, 165 bp, Homo sapiens
caattgctgagtacaatgctccttgcagcaaagatcttggaaatgcttgaagaccacaaggctgaaaagtgctttgctggagtcctgttctcagagctccmcagaagacacgtgtttttgtatctttaaagacttgatgaataaacactttttctggtcaatgtc

SEQ ID NO: 9753 - DNA, 201 bp, Homo sapiens
tccactgcctctctccgagccttccagcccttctttgtggagctcacaatgccttactctgtgattcgtggagaggccttcacactcaaggccacggtccwaaactaccttcccaaatgcatccgggtcagtgtgcagctggaagcctctcccgccttcctagctgtcccagtggagaaggaacaagcgcctcactgcatc

SEQ ID NO: 9754 - DNA, 201 bp, Homo sapiens
aatgcttgaaagatctaaccatgtgagccggacagaagtcagcagcaaccatgtcttgatttaccttgataaggtgtcaaatcagacactgagcttgttcytcacggttctgcaagatgtcccagtaagagatctgaaaccagccatagtgaaagtctatgattactacgagacggatgagtttgcaattgctgagtacaa

SEQ ID NO: 9755 - DNA, 201 bp, Homo sapiens
tagtccctgttacggctaccagtgggtgtcagaagaacacgaagaggcacatcacactgcttatcttgtgttctccccaagcaagagctttgtccaccttragcccatgtctcatgaactaccctgtggccatactcagacagtccaggcacattatattctgaatggaggcaccctgctggggctgaagaagctctcctt

SEQ ID NO: 9756 - DNA, 201 bp, Homo sapiens
tccaatgctaccacggatgagcatggccttgtacagttctctatcaacaccaccaatgttatgggtacctctcttactgttagggtcaattacaaggatcrtagtccctgttacggctaccagtgggtgtcagaagaacacgaagaggcacatcacactgcttatcttgtgttctccccaagcaagagctttgtccacctt

SEQ ID NO: 9757 - DNA, 201 bp, Homo sapiens
aaggccacggtcctaaactaccttcccaaatgcatccgggtcagtgtgcagctggaagcctctcccgccttcctagctgtcccagtggagaaggaacaagygcctcactgcatctgtgcaaacgggcggcaaactgtgtcctgggcagtaaccccaaagtcattaggaaatgtgaatttcactgtgagcgcagaggcacta

SEQ ID NO: 9758 - DNA, 176 bp, Homo sapiens
ggatgagtttgcaattgctgagtacaatgctccttgcagcaaagatcttggaaatgcttgaagaccacaaggctgaaaagtgctttgctggagtcctgttytcagagctccacagaagacacgtgtttttgtatctttaaagacttgatgaataaacactttttctggtcaatgtc

SEQ ID NO: 9759 - DNA, 201 bp, Homo sapiens
gctcatgaagcctgatgctgagctctcggcgtcctcggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagagga

SEQ ID NO: 9760 - DNA, 201 bp, Homo sapiens
ttgtacagttctctatcaacaccaccaatgttatgggtacctctcttactgttagggtcaattacaaggatcgtagtccctgttacggctaccagtgggtrtcagaagaacacgaagaggcacatcacactgcttatcttgtgttctccccaagcaagagctttgtccaccttgagcccatgtctcatgaactaccctgtg

SEQ ID NO: 9761 - DNA, 201 bp, Homo sapiens
caaataaagtcatattcatcagaggaaatgaagcaaactattactccaatgctaccacggatgagcatggccttgtacagttctctatcaacaccaccaaygttatgggtacctctcttactgttagggtcaattacaaggatcgtagtccctgttacggctaccagtgggtgtcagaagaacacgaagaggcacatcaca

SEQ ID NO: 9762 - DNA, 201 bp, Homo sapiens
gagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaagacaactctgtccattgggagcgccctcagaaacccaaggcaccagtggggcat

SEQ ID NO: 9763 - DNA, 201 bp, Homo sapiens
cttactctgtgattcgtggagaggccttcacactcaaggccacggtcctaaactaccttcccaaatgcatccgggtcagtgtgcagctggaagcctctccygccttcctagctgtcccagtggagaaggaacaagcgcctcactgcatctgtgcaaacgggcggcaaactgtgtcctgggcagtaaccccaaagtcattag

SEQ ID NO: 9764 - DNA, 201 bp, Homo sapiens
cggatgagcatggccttgtacagttctctatcaacaccaccaatgttatgggtacctctcttactgttagggtcaattacaaggatcgtagtccctgttayggctaccagtgggtgtcagaagaacacgaagaggcacatcacactgcttatcttgtgttctccccaagcaagagctttgtccaccttgagcccatgtctc

SEQ ID NO: 9765 - DNA, 201 bp, Homo sapiens
gtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggacacagtggtggctctccatgctctgtccaaatatggagcagccacatttaccaggact

SEQ ID NO: 9766 - DNA, 201 bp, Homo sapiens
ccagggattctatttagcccgccaggaattaaccttgactataaataggccatcaatgacctttccagagaatgttcagagacctcaactttgtttagagrtcttgtgtgggtggaacttcctgtttgcacacagagcagcataaagcccagttgctttgggaagtgtttgggaccagatggattgtagggagtagggtac

SEQ ID NO: 9767 - DNA, 201 bp, Homo sapiens
tggaacttcctgtttgcacacagagcagcataaagcccagttgctttgggaagtgtttgggaccagatggattgtagggagtagggtacaatacagtctgktctcctccagctccttctttctgcaacatggggaagaacaaactccttcatccaagtctggttcttctcctcttggtcctcctgcccacagacgcctcag

SEQ ID NO: 9768 - DNA, 201 bp, Homo sapiens
gaggacatgggcttaaaggcattcaccaactcaaagattcgtaaacccaaaatgtgtccacagcttcaacagtatgaaatgcatggacctgaaggtctacrtgtaggtttttatgagtcagatgtaatgggaagaggccatgcacgcctggtgcatgttgaagagcctcacacggagaccgtacgaaagtacttccctgag

SEQ ID NO: 9769 - DNA, 201 bp, Homo sapiens
ccagatgccctatggctgtggagagcagaatatggtcctctttgctcctaacatctatgtactggattatctaaatgaaacacagcagcttactccagagrtcaagtccaaggccattggctatctcaacactggttaccagagacagttgaactacaaacactatgatggctcctacagcacctttggggagcgatatgg

SEQ ID NO: 9770 - DNA, 201 bp, Homo sapiens
aactcgcttggatctatccaaaaatcagattcgtagcctttaccttcatccttcatttgggaagttgaattccttaaagtccatagatttttcctccaacmaaatattccttgtatgtgaacatgagctcgagcccctacaagggaaaacgctctccttttttagcctcgcagctaatagcttgtatagcagagtctcagt

SEQ ID NO: 9771 - DNA, 201 bp, Homo sapiens
gtggcaataaactagtgactttgccaaagatcaaccttacagcgaacctcatccacttatcagaaaacaggctagaaaatctagatattctctactttctyctacgggtacctcatctccagattctcattttaaatcaaaatcgcttctcctcctgtagtggagatcaaaccccttcagagaatcccagcttagaacagc

SEQ ID NO: 9772 - DNA, 201 bp, Homo sapiens
cagctcctagctcctaatcctgatgtatttgtatcacttagtgtcttggatataactcataacaagttcatttgtgaatgtgaacttagcacttttatcarttggcttaatcacaccaatgtcactatagctgggcctcctgcagacatatattgtgtgtaccctgactcgttctctggggtttccctcttctctctttcc

SEQ ID NO: 9773 - DNA, 201 bp, Homo sapiens
catggtggtggttgggtccttgtcccagtaccagttgatgaaacatcaatccatcagaggctttgtacagaaacagcagtatttgaggtggcctgaggatytccaggatgttggctggtttcttcataaactctctcaacagatactaaagaaagaaaaagaaaagaagaaagacaataacattccgttgcaaactgtagc

SEQ ID NO: 9774 - DNA, 201 bp, Homo sapiens
actacctaaggtagcctacattgatttgcaaaagaatcacattgcaataattcaagaccaaacattcaaattcctggaaaaattacagaccttggatctcygagacaatgctcttacaaccattcattttattccaagcatacccgatatcttcttgagtggcaataaactagtgactttgccaaagatcaaccttacagc

SEQ ID NO: 9775 - DNA, 201 bp, Homo sapiens
gccgaatagccttttatcgtttctgcaacctcacccaggtcccccaggtcctcaacaccactgagaggctcctgctgagcttcaactatatcaggacagtyactgcttcatccttcccctttctggaacagctgcagctgctggagctcgggagccagtatacccccttgactattgacaaggaggccttcagaaacctgc

SEQ ID NO: 9776 - DNA, 201 bp, Homo sapiens
gaatcttggacctgggaagtagtaagatatacttcttgcatccagatgcttttcagggactgttccatctgtttgaacttagactgtatttctgtggtctytctgatgctgtattgaaagatggttatttcagaaatttaaaggctttaactcgcttggatctatccaaaaatcagattcgtagcctttaccttcatcctt

SEQ ID NO: 9777 - DNA, 201 bp, Homo sapiens
gctttgtacagaaacagcagtatttgaggtggcctgaggatctccaggatgttggctggtttcttcataaactctctcaacagatactaaagaaagaaaargaaaagaagaaagacaataacattccgttgcaaactgtagcaaccatctcctaatcaaaggagcaatttccaacttatctcaagccacaaataactcttc

SEQ ID NO: 9778 - DNA, 201 bp, Homo sapiens
gagccagtatacccccttgactattgacaaggaggccttcagaaacctgcccaaccttagaatcttggacctgggaagtagtaagatatacttcttgcatscagatgcttttcagggactgttccatctgtttgaacttagactgtatttctgtggtctctctgatgctgtattgaaagatggttatttcagaaatttaaa

SEQ ID NO: 9779 - DNA, 201 bp, Homo sapiens
ttgtgaatgtgaacttagcacttttatcaattggcttaatcacaccaatgtcactatagctgggcctcctgcagacatatattgtgtgtaccctgactcgytctctggggtttccctcttctctctttccacggaaggttgtgatgaagaggaagtcttaaagtccctaaagttctcccttttcattgtatgcactgtcac

SEQ ID NO: 9780 - DNA, 201 bp, Homo sapiens
gaagttgaattccttaaagtccatagatttttcctccaaccaaatattccttgtatgtgaacatgagctcgagcccctacaagggaaaacgctctcctttyttagcctcgcagctaatagcttgtatagcagagtctcagtggactggggaaaatgtatgaacccattcagaaacatggtgctggagatactagatgtttc

SEQ ID NO: 9781 - DNA, 201 bp, Homo sapiens
gagaggctcctgctgagcttcaactatatcaggacagtcactgcttcatccttcccctttctggaacagctgcagctgctggagctcgggagccagtatayccccttgactattgacaaggaggccttcagaaacctgcccaaccttagaatcttggacctgggaagtagtaagatatacttcttgcatccagatgctttt

SEQ ID NO: 9782 - DNA, 112 bp, Homo sapiens
ggttttcaggakcccgagcgagggcgccgcttttgcgtccgggaggagccaaccgtggcgcaggcggcgcggggaggcgtcccagagtctcactctgccgcccaggctggac

SEQ ID NO: 9783 - DNA, 201 bp, Homo sapiens; identical to SEQ ID NO: 9770

SEQ ID NO: 9784 - DNA, 201 bp, Homo sapiens; identical to SEQ ID NO: 9771

SEQ ID NO: 9785 - DNA, 201 bp, Homo sapiens; identical to SEQ ID NO: 9772

SEQ ID NO: 9786 - DNA, 201 bp, Homo sapiens; identical to SEQ ID NO: 9773

SEQ ID NO: 9787 - DNA, 201 bp, Homo sapiens; identical to SEQ ID NO: 9774

SEQ ID NO: 9788 - DNA, 201 bp, Homo sapiens; identical to SEQ ID NO: 9775

SEQ ID NO: 9789 - DNA, 201 bp, Homo sapiens; identical to SEQ ID NO: 9776

SEQ ID NO: 9790 - DNA, 201 bp, Homo sapiens; identical to SEQ ID NO: 9777

SEQ ID NO: 9791 - DNA, 201 bp, Homo sapiens; identical to SEQ ID NO: 9778

SEQ ID NO: 9792 - DNA, 201 bp, Homo sapiens; identical to SEQ ID NO: 9779

SEQ ID NO: 9793 - DNA, 201 bp, Homo sapiens
ttgagaatgttggcgctgtccgaacctggagacaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgagg

SEQ ID NO: 9794 - DNA, 201 bp, Homo sapiens; identical to SEQ ID NO: 9780

SEQ ID NO: 9795 - DNA, 201 bp, Homo sapiens; identical to SEQ ID NO: 9781

SEQ ID NO: 9796 - DNA, 157 bp, Homo sapiens
aggcagcagaggaagccgaggggcggccatcttggctccgtgaggctctgaggtgcyggggtgcggcggcggcagcggcggccagcagggcggaggctgaggcagcaagctcgctagagagggagaagcagtcgggcgcaggcgcctcctccgcagc

SEQ ID NO: 9797 - DNA, 201 bp, Homo sapiens
cggatatcggggacatccatagccttcaaaaatattgcttccaaaattgccaatgagctaaagctgtaacccagtgattatgatgtaaattaagtagcaaktaaagtgttttcctgaacactgatggaaatgtatagaataatatttaggcaataacgtctgcatcttctaaatcatgaaattaaagtctgaggacgagag

SEQ ID NO: 9798 - DNA, 201 bp, Homo sapiens
catctccatgtgcctcccgtctgggtgggtgtgagagtggacggtatgtgtgtgaagtggtgtatatggaagcatctccctacactggcagccagtcattrctagtacctctgcgggagatcatccggtgctaaaacattacagttgccaaggaggaaaatactgaatgactgctaagaattaaccttaagaccagttcat

SEQ ID NO: 9799 - DNA, 201 bp, Homo sapiens
ttgacaaaactcagttgaatccaacaagtctacaaaagctcttcagagaagtaagaataatgaagattttaaatcatcccaatatagtgaagttattcgargtcattgaaactgaaaaaacactctacctaatcatggaatatgcaagtggaggtgaagtatttgactatttggttgcacatggcaggatgaaggaaaaag

SEQ ID NO: 9800 - DNA, 201 bp, Homo sapiens
ggaccagctattccttctgttgtggcgtatccgaaaaggagtcagaccagcactgcagatagtgacctcaaagaagatggaatttcctcccggaaatcaastggcagtgctgttggaggaaagggaattgctccagccagtcccatgcttgggaatgcaagtaatcctaataaggcggatattcctgaacgcaagaaaagc

SEQ ID NO: 9801 - DNA, 201 bp, Homo sapiens
gcaattaaagtgttttcctgaacactgatggaaatgtatagaataatatttaggcaataacgtctgcatcttctaaatcatgaaattaaagtctgaggacragagcacgcctgggagcgaaagctggccttttttctacgaatgcactacattaaagatgtgcaacctatgcgccccctgccctacttccgttaccctgag

SEQ ID NO: 9802 - DNA, 201 bp, Homo sapiens
cgcctgggagcgaaagctggccttttttctacgaatgcactacattaaagatgtgcaacctatgcgccccctgccctacttccgttaccctgagagtcggygtgtggccccatctccatgtgcctcccgtctgggtgggtgtgagagtggacggtatgtgtgtgaagtggtgtatatggaagcatctccctacactggcag

SEQ ID NO: 9803 - DNA, 201 bp, Homo sapiens
ggcaaagaaaacagcactattcctgatcagagaactccagttgcttcaacacacagtatcagtagtgcagccaccccagatcgaatccgcttcccaagagkcactgccagtcgtagcactttccacggccagccccgggaacggcgaaccgcaacatataatggccctcctgcctctcccagcctgtcccatgaagccaca

SEQ ID NO: 9804 - DNA, 201 bp, Homo sapiens
ttcttcaagccaaaagcaaagacgctacagtgaccatgctggaccagctattccttctgttgtggcgtatccgaaaaggagtcagaccagcactgcagatrgtgacctcaaagaagatggaatttcctcccggaaatcaagtggcagtgctgttggaggaaagggaattgctccagccagtcccatgcttgggaatgcaag

SEQ ID NO: 9805 - DNA, 201 bp, Homo sapiens
attcctgaacgcaagaaaagctccactgtccctagtagtaacacagcatctggtggaatgacacgacgaaatacttatgtttgcagtgagagaactacagmtgatagacactcagtgattcagaatggcaaagaaaacagcactattcctgatcagagaactccagttgcttcaacacacagtatcagtagtgcagccacc

SEQ ID NO: 9806 - DNA, 201 bp, Homo sapiens
agttctagcagcaatctttcacttgctaaggttaggccgagcagtgatctcaacaacagtactggccagtctcctcaccacaaagtgcagagaagtgtttyttcaagccaaaagcaaagacgctacagtgaccatgctggaccagctattccttctgttgtggcgtatccgaaaaggagtcagaccagcactgcagatagt

SEQ ID NO: 9807 - DNA, 201 bp, Homo sapiens
tgcagagaagtgtttcttcaagccaaaagcaaagacgctacagtgaccatgctggaccagctattccttctgttgtggcgtatccgaaaaggagtcagacmagcactgcagatagtgacctcaaagaagatggaatttcctcccggaaatcaagtggcagtgctgttggaggaaagggaattgctccagccagtcccatgc

SEQ ID NO: 9808 - DNA, 201 bp, Homo sapiens
tgaggcaaggggacgccggcgggccgaagcgcagcccgccgcccgcaggctcggctccgccactgccgccctcccggtctcctcgcctcggccgccgaggsagggagagaatgagccccgggacccgccgggggacggcccgggccaggcccgggatctagacggccgtagggggaagggagccgccctccccacggcgcc

SEQ ID NO: 9809 - DNA, 148 bp, Homo sapiens
aggcagcagaggaagccgaggggcggccatcttggctccgtgaggctytgaggtgccggggtgcggcggcggcagcggcggccagcagggcggaggctgaggcagcaagctcgctagagagggagaagcagtcgggcgcaggcgcctc

SEQ ID NO: 9810 - DNA, 157 bp, Homo sapiens; identical to SEQ ID NO: 9796

SEQ ID NO: 9811 - DNA, 201 bp, Homo sapiens; identical to SEQ ID NO: 9797

SEQ ID NO: 9812 - DNA, 201 bp, Homo sapiens; identical to SEQ ID NO: 9798

SEQ ID NO: 9813 - DNA, 201 bp, Homo sapiens; identical to SEQ ID NO: 9799

SEQ ID NO: 9814 - DNA, 201 bp, Homo sapiens; identical to SEQ ID NO: 9800

SEQ ID NO: 9815 - DNA, 201 bp, Homo sapiens; identical to SEQ ID NO: 9801

SEQ ID NO: 9816 - DNA, 201 bp, Homo sapiens; identical to SEQ ID NO: 9802

SEQ ID NO: 9817 - DNA, 201 bp, Homo sapiens; identical to SEQ ID NO: 9803

SEQ ID NO: 9818 - DNA, 201 bp, Homo sapiens; identical to SEQ ID NO: 9804

SEQ ID NO: 9819 - DNA, 201 bp, Homo sapiens; identical to SEQ ID NO: 9805

SEQ ID NO: 9820 - DNA, 201 bp, Homo sapiens; identical to SEQ ID NO: 9806

SEQ ID NO: 9821 - DNA, 201 bp, Homo sapiens; identical to SEQ ID NO: 9807

SEQ ID NO: 9822 - DNA, 201 bp, Homo sapiens; identical to SEQ ID NO: 9808

SEQ ID NO: 9823 - DNA, 148 bp, Homo sapiens; identical to SEQ ID NO: 9809

SEQ ID NO: 9824 - DNA, 157 bp, Homo sapiens; identical to SEQ ID NO: 9796

SEQ ID NO: 9825 - DNA, 201 bp, Homo sapiens; identical to SEQ ID NO: 9797

SEQ ID NO: 9826 - DNA, 201 bp, Homo sapiens; identical to SEQ ID NO: 9798

SEQ ID NO: 9827 - DNA, 201 bp, Homo sapiens; identical to SEQ ID NO: 9799

SEQ ID NO: 9828 - DNA, 201 bp, Homo sapiens; identical to SEQ ID NO: 9800

SEQ ID NO: 9829 - DNA, 201 bp, Homo sapiens; identical to SEQ ID NO: 9801

SEQ ID NO: 9830 - DNA, 201 bp, Homo sapiens; identical to SEQ ID NO: 9802

SEQ ID NO: 9831 - DNA, 201 bp, Homo sapiens; identical to SEQ ID NO: 9803

SEQ ID NO: 9832 - DNA, 201 bp, Homo sapiens; identical to SEQ ID NO: 9804

SEQ ID NO: 9833 - DNA, 201 bp, Homo sapiens; identical to SEQ ID NO: 9805

SEQ ID NO: 9834 - DNA, 201 bp, Homo sapiens; identical to SEQ ID NO: 9806

SEQ ID NO: 9835 - DNA, 201 bp, Homo sapiens; identical to SEQ ID NO: 9807

SEQ ID NO: 9836 - DNA, 201 bp, Homo sapiens; identical to SEQ ID NO: 9808

SEQ ID NO: 9837 - DNA, 148 bp, Homo sapiens; identical to SEQ ID NO: 9809

SEQ ID NO: 9838 - DNA, 157 bp, Homo sapiens; identical to SEQ ID NO: 9796

SEQ ID NO: 9839 - DNA, 201 bp, Homo sapiens; identical to SEQ ID NO: 9797

SEQ ID NO: 9840 - DNA, 201 bp, Homo sapiens; identical to SEQ ID NO: 9798

SEQ ID NO: 9841 - DNA, 201 bp, Homo sapiens; identical to SEQ ID NO: 9799

SEQ ID NO: 9842 - DNA, 201 bp, Homo sapiens; identical to SEQ ID NO: 9800

SEQ ID NO: 9843 - DNA, 201 bp, Homo sapiens; identical to SEQ ID NO: 9801

SEQ ID NO: 9844 - DNA, 201 bp, Homo sapiens; identical to SEQ ID NO: 9802

SEQ ID NO: 9845 - DNA, 201 bp, Homo sapiens; identical to SEQ ID NO: 9803

SEQ ID NO: 9846 - DNA, 201 bp, Homo sapiens; identical to SEQ ID NO: 9804

SEQ ID NO: 9847 - DNA, 201 bp, Homo sapiens; identical to SEQ ID NO: 9805

SEQ ID NO: 9848 - DNA, 201 bp, Homo sapiens; identical to SEQ ID NO: 9806

SEQ ID NO: 9849 - DNA, 201 bp, Homo sapiens; identical to SEQ ID NO: 9807

SEQ ID NO: 9850 - DNA, 201 bp, Homo sapiens; identical to SEQ ID NO: 9808

SEQ ID NO: 9851 - DNA, 148 bp, Homo sapiens; identical to SEQ ID NO: 9809

SEQ ID NO: 9852 - DNA, 157 bp, Homo sapiens; identical to SEQ ID NO: 9796

SEQ ID NO: 9853 - DNA, 201 bp, Homo sapiens; identical to SEQ ID NO: 9797

SEQ ID NO: 9854 - DNA, 201 bp, Homo sapiens; identical to SEQ ID NO: 9798

SEQ ID NO: 9855 - DNA, 201 bp, Homo sapiens; identical to SEQ ID NO: 9799

SEQ ID NO: 9856 - DNA, 201 bp, Homo sapiens; identical to SEQ ID NO: 9800

SEQ ID NO: 9857 - DNA, 201 bp, Homo sapiens; identical to SEQ ID NO: 9801

SEQ ID NO: 9858 - DNA, 201 bp, Homo sapiens; identical to SEQ ID NO: 9802

SEQ ID NO: 9859 - DNA, 201 bp, Homo sapiens; identical to SEQ ID NO: 9803

SEQ ID NO: 9860 - DNA, 201 bp, Homo sapiens; identical to SEQ ID NO: 9804

SEQ ID NO: 9861 - DNA, 201 bp, Homo sapiens; identical to SEQ ID NO: 9805

SEQ ID NO: 9862 - DNA, 201 bp, Homo sapiens
tatttgttattggggagaaaatcttcagaggttaggccgagcagtgatctcaacaacagtactggccagtctcctcaccacaaagtgcagagaagtgtttyttcaagccaaaagcaaagacgctacagtgaccatgctggaccagctattccttctgttgtggcgtatccgaaaaggagtcagaccagcactgcagatagt

SEQ ID NO: 9863 - DNA, 201 bp, Homo sapiens; identical to SEQ ID NO: 9807

SEQ ID NO: 9864 - DNA, 201 bp, Homo sapiens; identical to SEQ ID NO: 9808

SEQ ID NO: 9865 - DNA, 148 bp, Homo sapiens; identical to SEQ ID NO: 9809

SEQ ID NO: 9866 - DNA, 157 bp, Homo sapiens; identical to SEQ ID NO: 9796

SEQ ID NO: 9867 - DNA, 201 bp, Homo sapiens; identical to SEQ ID NO: 9797

SEQ ID NO: 9868 - DNA, 201 bp, Homo sapiens; identical to SEQ ID NO: 9798

SEQ ID NO: 9869 - DNA, 201 bp, Homo sapiens; identical to SEQ ID NO: 9799

SEQ ID NO: 9870 - DNA, 201 bp, Homo sapiens; identical to SEQ ID NO: 9800

SEQ ID NO: 9871 - DNA, 201 bp, Homo sapiens; identical to SEQ ID NO: 9801

SEQ ID NO: 9872 - DNA, 201 bp, Homo sapiens; identical to SEQ ID NO: 9802

SEQ ID NO: 9873 - DNA, 201 bp, Homo sapiens; identical to SEQ ID NO: 9803

SEQ ID NO: 9874 - DNA, 201 bp, Homo sapiens; identical to SEQ ID NO: 9804

SEQ ID NO: 9875 - DNA, 201 bp, Homo sapiens; identical to SEQ ID NO: 9805

SEQ ID NO: 9876 - DNA, 201 bp, Homo sapiens; identical to SEQ ID NO: 9862

SEQ ID NO: 9877 - DNA, 201 bp, Homo sapiens; identical to SEQ ID NO: 9807

SEQ ID NO: 9878 - DNA, 201 bp, Homo sapiens; identical to SEQ ID NO: 9808

SEQ ID NO: 9879 - DNA, 148 bp, Homo sapiens; identical to SEQ ID NO: 9809

SEQ ID NO: 9880 - DNA, 201 bp, Homo sapiens
agcgagctggacatgctgcaggctgaggcgcttcaggactccctccagcatcttatgaaagtacaggggaccatcaagtggagggaggaccacattgccawtaaaaggtccctgaattctaaattctggaagcacgtgaggtaccaaatgcctgtgccaagcaaaattcccagaaaggcctctagtttgactcccttggct

SEQ ID NO: 9881 - DNA, 201 bp, Homo sapiens
agcacctcttgagtggtttaagaattgtcaggctcttcaaggatcaaggtacagggcgcacaagtcatttttggtcattgataatgtgatgactgaggacrcaggtgattacacctgtaaatttatacacaatgaaaatggagccaattatagtgtgacggcgaccaggtccttcacggtcaaggtttggtgtcagagttt

SEQ ID NO: 9882 - DNA, 201 bp, Homo sapiens
ctgtgccctcatccagaacgacgccaaggtgatacttattgagatggaggctctgagcgagctggacatgctgcaggctgaggcgcttcaggactccctcmagcatcttatgaaagtacaggggaccatcaagtggagggaggaccacattgccaataaaaggtccctgaattctaaattctggaagcacgtgaggtacca

SEQ ID NO: 9883 - DNA, 201 bp, Homo sapiens
tgtgccctcatccagaacgacgccaaggtgatacttattgagatggaggctctgagcgagctggacatgctgcaggctgaggcgcttcaggactccctccrgcatcttatgaaagtacaggggaccatcaagtggagggaggaccacattgccaataaaaggtccctgaattctaaattctggaagcacgtgaggtaccaa

SEQ ID NO: 9884 - DNA, 114 bp, Homo sapiens
tatgaggagggacytacaaagactggaaactattcttagctccgtcactgactccaagttcatcccctctgtctttcagtttggttgagatataggctactcttcccaactcag

SEQ ID NO: 9885 - DNA, 201 bp, Homo sapiens
gccaataaaaggtccctgaattctaaattctggaagcacgtgaggtaccaaatgcctgtgccaagcaaaattcccagaaaggcctctagtttgactccctyggctgcccagaagcaatagtgcctgctgtgatgtgcaaaggcatctgagtttgaagctttcctgacttctcctagctggcttatgcccctgcactgaagt

SEQ ID NO: 9886 - DNA, 201 bp, Homo sapiens
cacattgccaataaaaggtccctgaattctaaattctggaagcacgtgaggtaccaaatgcctgtgccaagcaaaattcccagaaaggcctctagtttgaytcccttggctgcccagaagcaatagtgcctgctgtgatgtgcaaaggcatctgagtttgaagctttcctgacttctcctagctggcttatgcccctgcac

SEQ ID NO: 9887 - DNA, 201 bp, Homo sapiens
ctttgttcaccagattctgcctgatgttcttgaaaataaatgtggctataccttatgcatttatgggagagatatgctacctggagaagatgtagtcactrcagtggaaaccaacatacgaaagagcaggcggcacattttcatcctgacccctcagatcactcacaataaggagtttgcctacgagcaggaggttgccct

SEQ ID NO: 9888 - DNA, 201 bp, Homo sapiens
aggctgaggcgcttcaggactccctccagcatcttatgaaagtacaggggaccatcaagtggagggaggaccacattgccaataaaaggtccctgaattcyaaattctggaagcacgtgaggtaccaaatgcctgtgccaagcaaaattcccagaaaggcctctagtttgactcccttggctgcccagaagcaatagtgcc

SEQ ID NO: 9889 - DNA, 201 bp, Homo sapiens
accgtggattggtattactcacaaacaaacaaaagtattcccactcaggaaagaaatcgtgtgtttgcctcaggccaacttctgaagtttctaccagctgmagttgctgattctggtatttatacctgtattgtcagaagtcccacattcaataggactggatatgcgaatgtcaccatatataaaaaacaatcagattgc

SEQ ID NO: 9890 - DNA, 201 bp, Homo sapiens
ttacagactttggtgaaccaagaattcaacaagaggaagggcaaaatcaaagtttcagcaatgggctggcttgtctagacatggttttaagaatagctgaygtgaaggaagaggatttattgctgcagtacgactgtctggccctgaatttgcatggcttgagaaggcacaccgtaagactaagtaggaaaaatccaattg

SEQ ID NO: 9891 - DNA, 201 bp, Homo sapiens
gagatatgctacctggagaagatgtagtcactgcagtggaaaccaacatacgaaagagcaggcggcacattttcatcctgacccctcagatcactcacaayaaggagtttgcctacgagcaggaggttgccctgcactgtgccctcatccagaacgacgccaaggtgatacttattgagatggaggctctgagcgagctgg

SEQ ID NO: 9892 - DNA, 201 bp, Homo sapiens
aagatgtagtcactgcagtggaaaccaacatacgaaagagcaggcggcacattttcatcctgacccctcagatcactcacaataaggagtttgcctacgarcaggaggttgccctgcactgtgccctcatccagaacgacgccaaggtgatacttattgagatggaggctctgagcgagctggacatgctgcaggctgagg

SEQ ID NO: 9893 - DNA, 201 bp, Homo sapiens
agtgtgacggcgaccaggtccttcacggtcaaggtttggtgtcagagtttctgcaaattaaaaaagagcttaatctttagtaatactcattggattcaaartttaatgagaggctttgtgatggtatactatggtgtacataaatgttgtcgagtggtttttaatctttgtttgcaatactttcaacatcatcaatggcct

SEQ ID NO: 9894 - DNA, 201 bp, Homo sapiens
atcccctctgtctttcagtttggttgagatataggctactcttcccaactcagtcttgaagagtatcaccaactgcctcatgtgtggtgaccttcactgtygtatgccagtgactcatctggagtaatctcaacaacgagttaccaatacttgctcttgattgataaacagaatggggttttggatcttagcaattctcac

SEQ ID NO: 9895 - DNA, 201 bp, Homo sapiens
tcccctctgtctttcagtttggttgagatataggctactcttcccaactcagtcttgaagagtatcaccaactgcctcatgtgtggtgaccttcactgtcrtatgccagtgactcatctggagtaatctcaacaacgagttaccaatacttgctcttgattgataaacagaatggggttttggatcttagcaattctcaca

SEQ ID NO: 9896 - DNA, 201 bp, Homo sapiens
gattggtattactcacaaacaaacaaaagtattcccactcaggaaagaaatcgtgtgtttgcctcaggccaacttctgaagtttctaccagctgcagttgytgattctggtatttatacctgtattgtcagaagtcccacattcaataggactggatatgcgaatgtcaccatatataaaaaacaatcagattgcaatgtt

SEQ ID NO: 9897 - DNA, 201 bp, Homo sapiens
tgtgacggcgaccaggtccttcacggtcaaggtttggtgtcagagtttctgcaaattaaaaaagagcttaatctttagtaatactcattggattcaaagtytaatgagaggctttgtgatggtatactatggtgtacataaatgttgtcgagtggtttttaatctttgtttgcaatactttcaacatcatcaatggccttg

SEQ ID NO: 9898 - DNA, 201 bp, Homo sapiens
tccatccagcctgcccactcacactgcccttgtgtactcctgctttgctacgttatcattgatcaatgtccctggttacctatgtgtttgaattatcttcrtgttacaggtgtttaatgattttgctccttctagcttatttgtatttcacctgtttttctttaaatcaacatggttacactctgtttcagcaactgtata

SEQ ID NO: 9899 - DNA, 201 bp, Homo sapiens
atcacctcccaccaggctccacctcgaatactggggattaccattcagcatgagatttgggcaggaacacagacccaaaccataccacacacattatcatygttaaactttgtaaagtatttaaggtacatggaacacacgggaagtctggtagctcagcccatttctttattgcatctgttattcaccatgtaattcagg

SEQ ID NO: 9900 - DNA, 201 bp, Homo sapiens; identical to SEQ ID NO: 9881

SEQ ID NO: 9901 - DNA, 201 bp, Homo sapiens
cggctctgcaggctgtatgggaagcatggcggcatctgcttctggggacacctcaggagctttactcatggcagaaggcaaagcaaaggcaggcacttcamacagtaaaagcaggagcgagagagaggtgccacactgaaacagccagatctcatgagaagtcactcactattgcaaggacagcatcaaagagatggtgct

SEQ ID NO: 9902 - DNA, 201 bp, Homo sapiens
tactttataataagacatttgttaggccattcttgcattgatataaagaaatacctgagactgggtgatttatatgaaaagaggtttaattggctcacggytctgcaggctgtatgggaagcatggcggcatctgcttctggggacacctcaggagctttactcatggcagaaggcaaagcaaaggcaggcacttcaaaca

SEQ ID NO: 9903 - DNA, 114 bp, Homo sapiens; identical to SEQ ID NO: 9884

SEQ ID NO: 9904 - DNA, 201 bp, Homo sapiens
gctactttataataagacatttgttaggccattcttgcattgatataaagaaatacctgagactgggtgatttatatgaaaagaggtttaattggctcacrgctctgcaggctgtatgggaagcatggcggcatctgcttctggggacacctcaggagctttactcatggcagaaggcaaagcaaaggcaggcacttcaaa

SEQ ID NO: 9905 - DNA, 201 bp, Homo sapiens
agcattgtatcccgtataaaaggaaggaaagagagaaatatatttttacactcatcactcctcaggggctgtacaatcatgtagaaattgtttaatgtgcytgtcaaatagccaaagagtgttaaaccctgagttcccacccatgtgtgtggtatggttaggattcatccagatacacagagagaggcacaacaggaggag

SEQ ID NO: 9906 - DNA, 201 bp, Homo sapiens; identical to SEQ ID NO: 9889

SEQ ID NO: 9907 - DNA, 201 bp, Homo sapiens
atatttatgtttggtaaattcaataactttcctcatcatttggaaagtcaaattgtttattgcttccctacagttttttctgaatctagcaggattttaaygatatcattataatttgacacaataaaaggacaacatgaaactgatgaatctttattgggttaatttcagacactatataatcttttaaaaatgtaacat

SEQ ID NO: 9908 - DNA, 201 bp, Homo sapiens
ttacagactttggtgaaccaagaattcaacaagaggaagggcaaaatcaaagtttcagcaatgggctggcttgtctagacatggttttaagaatagctgaygtgaaggaagaggatttattgctgcagtacgactgtctggccctgaatttgcatggcttgagaaggcacaccgtaagactaagtaggaaaaatccaagta

SEQ ID NO: 9909 - DNA, 201 bp, Homo sapiens
ctcccaccaggctccacctcgaatactggggattaccattcagcatgagatttgggcaggaacacagacccaaaccataccacacacattatcatcgttaractttgtaaagtatttaaggtacatggaacacacgggaagtctggtagctcagcccatttctttattgcatctgttattcaccatgtaattcaggtacca

SEQ ID NO: 9910 - DNA, 201 bp, Homo sapiens
gtatgtgaaaggaaatgcaccaacaaccgtaaactgaacgtgttcttttgtgctcttttataacttgcattacatgttgtaagcatggtccgttctatacstttttctggtcataatgaacactcattttgttagcgagggtggtaaagtgaacaaaaaggggaagtatcaaactactgccatttcagtgagaaaatccta

SEQ ID NO: 9911 - DNA, 201 bp, Homo sapiens
ttgtctagaacactcagctgcttctttggtcatccttgttttctaactttatgaactccctctgtgtcactgtatgtgaaaggaaatgcaccaacaaccgwaaactgaacgtgttcttttgtgctcttttataacttgcattacatgttgtaagcatggtccgttctatacctttttctggtcataatgaacactcatttt

SEQ ID NO: 9912 - DNA, 201 bp, Homo sapiens; identical to SEQ ID NO: 9893

SEQ ID NO: 9913 - DNA, 201 bp, Homo sapiens
gaactttctctagcaagtgtaagcagaatggagtgtggttccaagagatccatcaagacaatgggaatggcctgtgccataaaatgtgcttctcttcttcrggatgttgtttgctgtctgatctttgtagactgttcctgtttgctgggagcttctctgctgcttaaattgttcgtcctcccccactccctcctatcgttg

SEQ ID NO: 9914 - DNA, 201 bp, Homo sapiens; identical to SEQ ID NO: 9894

SEQ ID NO: 9915 - DNA, 201 bp, Homo sapiens
ccaggaaggctgtggaccccatcaaggtgctatgtgagggccatgcttggggtggtggtgggcccagtagaccctgcagccatccatccagcctgcccacycacactgcccttgtgtactcctgctttgctacgttatcattgatcaatgtccctggttacctatgtgtttgaattatcttcgtgttacaggtgtttaatg

SEQ ID NO: 9916 - DNA, 201 bp, Homo sapiens; identical to SEQ ID NO: 9895

SEQ ID NO: 9917 - DNA, 201 bp, Homo sapiens; identical to SEQ ID NO: 9896

SEQ ID NO: 9918 - DNA, 201 bp, Homo sapiens; identical to SEQ ID NO: 9897

SEQ ID NO: 9919 - DNA, 201 bp, Homo sapiens; identical to SEQ ID NO: 9898

SEQ ID NO: 9920 - DNA, 201 bp, Homo sapiens; identical to SEQ ID NO: 9899

SEQ ID NO: 9921 - DNA, 201 bp, Homo sapiens
agcacctcttgagtggtttaagaattgtcaggctcttcaaggatcaaggtacagggcgcacaagtcatttttggtcattgataatgtgatgactgaggacrcaggtgattacacctgtaaatttatacacaatgaaaatggagccaattatagtgtgacggcgaccaggtccttcacggtcaaggatgagcaaggcttttc

SEQ ID NO: 9922 - DNA, 201 bp, Homo sapiens; identical to SEQ ID NO: 9901

SEQ ID NO: 9923 - DNA, 201 bp, Homo sapiens; identical to SEQ ID NO: 9902

SEQ ID NO: 9924 - DNA, 114 bp, Homo sapiens; identical to SEQ ID NO: 9884

SEQ ID NO: 9925 - DNA, 201 bp, Homo sapiens; identical to SEQ ID NO: 9904

SEQ ID NO: 9926 - DNA, 201 bp, Homo sapiens; identical to SEQ ID NO: 9905

SEQ ID NO: 9927 - DNA, 201 bp, Homo sapiens; identical to SEQ ID NO: 9889

SEQ ID NO: 9928 - DNA, 201 bp, Homo sapiens; identical to SEQ ID NO: 9907

SEQ ID NO: 9929 - DNA, 201 bp, Homo sapiens; identical to SEQ ID NO: 9908

SEQ ID NO: 9930 - DNA, 201 bp, Homo sapiens; identical to SEQ ID NO: 9909

SEQ ID NO: 9931 - DNA, 201 bp, Homo sapiens; identical to SEQ ID NO: 9910

SEQ ID NO: 9932 - DNA, 201 bp, Homo sapiens; identical to SEQ ID NO: 9911

SEQ ID NO: 9933 - DNA, 201 bp, Homo sapiens; identical to SEQ ID NO: 9913

SEQ ID NO: 9934 - DNA, 201 bp, Homo sapiens; identical to SEQ ID NO: 9894

SEQ ID NO: 9935 - DNA, 201 bp, Homo sapiens; identical to SEQ ID NO: 9915

SEQ ID NO: 9936 - DNA, 201 bp, Homo sapiens; identical to SEQ ID NO: 9895

SEQ ID NO: 9937 - DNA, 201 bp, Homo sapiens; identical to SEQ ID NO: 9896

SEQ ID NO: 9938 - DNA, 201 bp, Homo sapiens
aggacatatgagaaaactgaccatcagtatatttgtccagataattggtggatcaaaaatgccacttaacaggaagtttagtttgttatgcactttaaatkgaataattagcttgttacaattctaggacatggtgtttaaaatttaaatctgattaatccattttaacaaacaatgcaaacatcttcagtgcagaaggaa

SEQ ID NO: 9939 - DNA, 201 bp, Homo sapiens
gcagtgggatcactttcacaatcaacaggaggacactgatagctgctccgaatctgtgaaatttgatgctcgctcaatgacagctttgcttcctccgaatsctaaaaacagcccttcccttcaagagaaactgaagtccttcaaagctgcactgattgccctttacctcctcgtgtttgcagttctcatccctctcattgg

SEQ ID NO: 9940 - DNA, 201 bp, Homo sapiens
cacaatcaacaggaggacactgatagctgctccgaatctgtgaaatttgatgctcgctcaatgacagctttgcttcctccgaatcctaaaaacagcccttmccttcaagagaaactgaagtccttcaaagctgcactgattgccctttacctcctcgtgtttgcagttctcatccctctcattggaatagtggcagctcaa

SEQ ID NO: 9941 - DNA, 201 bp, Homo sapiens
tgtgaaatttgatgctcgctcaatgacagctttgcttcctccgaatcctaaaaacagcccttcccttcaagagaaactgaagtccttcaaagctgcactgrttgccctttacctcctcgtgtttgcagttctcatccctctcattggaatagtggcagctcaactcctgaagtgggaaacgaagaattgctcagttagttc

SEQ ID NO: 9942 - DNA, 201 bp, Homo sapiens
gaaaatgcatttttatcatgtaacattcttctacttgtttaacattgctgattttctctggcagcataattttgtggttaagagaatgaattctgaatgtwcactttctgtctcaaaccctggctgtaatttcagctagttaataattctttgtgttcagttccactatctaggtattttcttcaaaaggtaaatacaatg

SEQ ID NO: 9943 - DNA, 201 bp, Homo sapiens
aagggtaatagaaatgcataccagtaattggctccaattcataatatgttcaccaggagattacaattttttgctcttcttgtctttgtaatctatttagwtgattttaattactttctgaataacggaagggatcagaagatatcttttgtgcctagattgcaaaatctccaatccacacatattgttttaaaataagaa

SEQ ID NO: 9944 - DNA, 201 bp, Homo sapiens
ctgtttgggcctctgctcccatgctcatacctcttcttactccaattactccatttacgaaagttcgactggtcggtgggagcggccctcacgaggggagrgtggagatactccacagcggccagtggggtacaatttgtgacgatcgctgggaagtgcgcgttggacaggtcgtctgtaggagcttgggatacccaggtg

SEQ ID NO: 9945 - DNA, 201 bp, Homo sapiens
tcagccctgaaaataacagaattctgaagtttcctatgactaattcacaaaaaaagtaattgtaaactagtactattatggaattactctactgttctttytttaatagtggcaaatgaaagcataagcttaagcattttttcatattctgaagtctcaccacacataataaccaagtggtagactcacagccgtccaact

SEQ ID NO: 9946 - DNA, 201 bp, Homo sapiens
ttaacattgctgattttctctggcagcataattttgtggttaagagaatgaattctgaatgtacactttctgtctcaaaccctggctgtaatttcagctakttaataattctttgtgttcagttccactatctaggtattttcttcaaaaggtaaatacaatggtttctgaaagaatcatttgcattatcagcctgtttgg

SEQ ID NO: 9947 - DNA, 201 bp, Homo sapiens
ggcagctcaactcctgaagtgggaaacgaagaattgctcagttagttcaactaatgcaaatgatataactcaaagtctcacgggaaaaggaaatgacagcraagaggaaatgagatttcaagaagtctttatggaacacatgagcaacatggagaagagaatccagcatattttagacatggaagccaacctcatggacac

SEQ ID NO: 9948 - DNA, 201 bp, Homo sapiens
tttgcattatcagcctgtttgggatgtctgagatcagtgcctctgggttgttaatactgtattgctgtatggtatatgtatgctgatttactacttatgcrtaagtggtatgcatgggatgtctgaaatcagtgcctatgggttgtcaatagtattaactattagtgttaactgttagtattaactattagtattattaac

SEQ ID NO: 9949 - DNA, 201 bp, Homo sapiens
ttggaacaggaaataaaaggagaagtgaaagtactgaataacatcactaatgatctcagactgaaagattgggaacattctcagaccttgagaaatatcaytttaattcaaggtcctcctggacccccgggtgaaaaaggagatcgaggtcccactggagaaagtggtccacgaggatttccaggtccaataggtcctccg

SEQ ID NO: 9950 - DNA, 201 bp, Homo sapiens
ttatgaagtcagtcaacatttacaaccaaagggcgggggggggggtggggggtgcgtctttagtcctaaagggacaataactctgagcatgccccaaaaargtagtttagcaaccttttgttggtagtcaacccatccccagggccatagtgtagagtgtgaaaagctaccctgaaacccagtaattctaccctgaaagtg

SEQ ID NO: 9951 - DNA, 201 bp, Homo sapiens
taagaatattgcccaaataatattttagattacaggattaatatattgaacaccttcatgcttactattttatgtctatatttaaatcattttaacttctrtaggtttttaaatggaattttctaatataatgacttatatgctgaattgaacattttgaagtttatagcttccagattacaaaggccaagggtaatagaa

SEQ ID NO: 9952 - DNA, 201 bp, Homo sapiens
atcgctgctcaaaaatgattttattaccttgttcctgtaaaatccatttaatcaatatttaagagattaagaatattgcccaaataatattttagattacrggattaatatattgaacaccttcatgcttactattttatgtctatatttaaatcattttaacttctataggtttttaaatggaattttctaatataatga

SEQ ID NO: 9953 - DNA, 201 bp, Homo sapiens
ggatcagaagatatcttttgtgcctagattgcaaaatctccaatccacacatattgttttaaaataagaatgttatccaactattaagatatctcaatgtrcaataacttgtgtattagatatcaatgttaatgatatgtcttggccactatggaccagggagcttatttttcttgtcatgtactgacaactgtttaattg

SEQ ID NO: 9954 - DNA, 201 bp, Homo sapiens
acgaagaattgctcagttagttcaactaatgcaaatgatataactcaaagtctcacgggaaaaggaaatgacagcgaagaggaaatgagatttcaagaagyctttatggaacacatgagcaacatggagaagagaatccagcatattttagacatggaagccaacctcatggacacagagcatttccaaaatttcagcatg

SEQ ID NO: 9955 - DNA, 201 bp, Homo sapiens
aaggtgatcggggagcaattggctttcctggaagtcgaggactcccaggatatgccggaaggccaggaaattctggaccaaaaggccagaaaggggaaaargggagtggaaacacattaagaccagtacaactcactgatcatattagggcagggccctcttaagatcaggtgggttgggcgggacatcctctgctaccat

SEQ ID NO: 9956 - DNA, 201 bp, Homo sapiens
tttccaaaatttcagcatgacaactgatcaaagatttaatgacattcttctgcagctaagtaccttgttttcctcagtccagggacatgggaatgcaatakatgaaatctccaagtccttaataagtttgaataccacattgcttgatttgcagctcaacatagaaaatctgaatggcaaaatccaagagaataccttcaa

SEQ ID NO: 9957 - DNA, 201 bp, Homo sapiens
ggaacattctcagaccttgagaaatatcactttaattcaaggtcctcctggacccccgggtgaaaaaggagatcgaggtcccactggagaaagtggtccaygaggatttccaggtccaataggtcctccgggtcttaaaggtgatcggggagcaattggctttcctggaagtcgaggactcccaggatatgccggaaggcc

SEQ ID NO: 9958 - DNA, 201 bp, Homo sapiens
aggagaagtgaaagtactgaataacatcactaatgatctcagactgaaagattgggaacattctcagaccttgagaaatatcactttaattcaaggtcctsctggacccccgggtgaaaaaggagatcgaggtcccactggagaaagtggtccacgaggatttccaggtccaataggtcctccgggtcttaaaggtgatcg

SEQ ID NO: 9959 - DNA, 201 bp, Homo sapiens
catgctcatacctcttcttactccaattactccatttacgaaagttcgactggtcggtgggagcggccctcacgaggggagagtggagatactccacagcrgccagtggggtacaatttgtgacgatcgctgggaagtgcgcgttggacaggtcgtctgtaggagcttgggatacccaggtgttcaagccgtgcacaaggc

SEQ ID NO: 9960 - DNA, 201 bp, Homo sapiens
ggtactggtccaatatggctgaatgaagtgttttgttttgggagagaatcatctattgaagaatgtaaaattcggcaatgggggacaagagcctgttcacrttctgaagatgctggagtcacttgcactttataatgcatcatattttcattcacaactatgaaatcgctgctcaaaaatgattttattaccttgttcctg

SEQ ID NO: 9961 - DNA, 201 bp, Homo sapiens
gcatgccccaaaaaagtagtttagcaaccttttgttggtagtcaacccatccccagggccatagtgtagagtgtgaaaagctaccctgaaacccagtaatyctaccctgaaagtgactgcctgcagaaagaccagcagttgatattaaagcgcaaatgaattcaacctcagccctgaaaataacagaattctgaagtttcc

SEQ ID NO: 9962 - DNA, 201 bp, Homo sapiens
ccttgttcctgtaaaatccatttaatcaatatttaagagattaagaatattgcccaaataatattttagattacaggattaatatattgaacaccttcatrcttactattttatgtctatatttaaatcattttaacttctataggtttttaaatggaattttctaatataatgacttatatgctgaattgaacattttga

SEQ ID NO: 9963 - DNA, 201 bp, Homo sapiens
tattgaacaccttcatgcttactattttatgtctatatttaaatcattttaacttctataggtttttaaatggaattttctaatataatgacttatatgcygaattgaacattttgaagtttatagcttccagattacaaaggccaagggtaatagaaatgcataccagtaattggctccaattcataatatgttcaccag

SEQ ID NO: 9964 - DNA, 201 bp, Homo sapiens
tttaacttctataggtttttaaatggaattttctaatataatgacttatatgctgaattgaacattttgaagtttatagcttccagattacaaaggccaasggtaatagaaatgcataccagtaattggctccaattcataatatgttcaccaggagattacaattttttgctcttcttgtctttgtaatctatttagttg

SEQ ID NO: 9965 - DNA, 201 bp, Homo sapiens
gttatgcactttaaatggaataattagcttgttacaattctaggacatggtgtttaaaatttaaatctgattaatccattttaacaaacaatgcaaacatyttcagtgcagaaggaagagtggtttcaactgtttggagtcttttatgaagtcagtcaacatttacaaccaaagggcgggggggggggtggggggtgcgtc

SEQ ID NO: 9966 - DNA, 201 bp, Homo sapiens
aatcatctattgaagaatgtaaaattcggcaatgggggacaagagcctgttcacattctgaagatgctggagtcacttgcactttataatgcatcatattktcattcacaactatgaaatcgctgctcaaaaatgattttattaccttgttcctgtaaaatccatttaatcaatatttaagagattaagaatattgcccaa

SEQ ID NO: 9967 - DNA, 201 bp, Homo sapiens
ttacaattctaggacatggtgtttaaaatttaaatctgattaatccattttaacaaacaatgcaaacatcttcagtgcagaaggaagagtggtttcaactktttggagtcttttatgaagtcagtcaacatttacaaccaaagggcgggggggggggtggggggtgcgtctttagtcctaaagggacaataactctgagca

SEQ ID NO: 9968 - DNA, 201 bp, Homo sapiens
aagtcagtcaacatttacaaccaaagggcgggggggggggtggggggtgcgtctttagtcctaaagggacaataactctgagcatgccccaaaaaagtagyttagcaaccttttgttggtagtcaacccatccccagggccatagtgtagagtgtgaaaagctaccctgaaacccagtaattctaccctgaaagtgactgc

SEQ ID NO: 9969 - DNA, 201 bp, Homo sapiens
gacaataactctgagcatgccccaaaaaagtagtttagcaaccttttgttggtagtcaacccatccccagggccatagtgtagagtgtgaaaagctaccckgaaacccagtaattctaccctgaaagtgactgcctgcagaaagaccagcagttgatattaaagcgcaaatgaattcaacctcagccctgaaaataacaga

SEQ ID NO: 9970 - DNA, 201 bp, Homo sapiens
tttagcaaccttttgttggtagtcaacccatccccagggccatagtgtagagtgtgaaaagctaccctgaaacccagtaattctaccctgaaagtgactgyctgcagaaagaccagcagttgatattaaagcgcaaatgaattcaacctcagccctgaaaataacagaattctgaagtttcctatgactaattcacaaaaa

SEQ ID NO: 9971 - DNA, 201 bp, Homo sapiens
ataatatgttcaccaggagattacaattttttgctcttcttgtctttgtaatctatttagttgattttaattactttctgaataacggaagggatcagaaratatcttttgtgcctagattgcaaaatctccaatccacacatattgttttaaaataagaatgttatccaactattaagatatctcaatgtgcaataactt

SEQ ID NO: 9972 - DNA, 201 bp, Homo sapiens
tggtagtcaacccatccccagggccatagtgtagagtgtgaaaagctaccctgaaacccagtaattctaccctgaaagtgactgcctgcagaaagaccagyagttgatattaaagcgcaaatgaattcaacctcagccctgaaaataacagaattctgaagtttcctatgactaattcacaaaaaaagtaattgtaaacta

SEQ ID NO: 9973 - DNA, 201 bp, Homo sapiens
tgcagctcaacatagaaaatctgaatggcaaaatccaagagaataccttcaaacaacaagaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactga

SEQ ID NO: 9974 - DNA, 201 bp, Homo sapiens
aggacactgatagctgctccgaatctgtgaaatttgatgctcgctcaatgacagctttgcttcctccgaatcctaaaaacagcccttcccttcaagagaarctgaagtccttcaaagctgcactgattgccctttacctcctcgtgtttgcagttctcatccctctcattggaatagtggcagctcaactcctgaagtggg

SEQ ID NO: 9975 - DNA, 201 bp, Homo sapiens; identical to SEQ ID NO: 9938

SEQ ID NO: 9976 - DNA, 201 bp, Homo sapiens; identical to SEQ ID NO: 9939

SEQ ID NO: 9977 - DNA, 201 bp, Homo sapiens; identical to SEQ ID NO: 9940

SEQ ID NO: 9978 - DNA, 201 bp, Homo sapiens; identical to SEQ ID NO: 9941

SEQ ID NO: 9979 - DNA, 201 bp, Homo sapiens; identical to SEQ ID NO: 9942

SEQ ID NO: 9980 - DNA, 201 bp, Homo sapiens; identical to SEQ ID NO: 9943

SEQ ID NO: 9981 - DNA, 201 bp, Homo sapiens
ctggaccaaaaggccagaaaggggaaaaggggagtggaaacacattaactccatttacgaaagttcgactggtcggtgggagcggccctcacgaggggagrgtggagatactccacagcggccagtggggtacaatttgtgacgatcgctgggaagtgcgcgttggacaggtcgtctgtaggagcttgggatacccaggtg

SEQ ID NO: 9982 - DNA, 201 bp, Homo sapiens; identical to SEQ ID NO: 9945

SEQ ID NO: 9983 - DNA, 201 bp, Homo sapiens; identical to SEQ ID NO: 9946

SEQ ID NO: 9984 - DNA, 201 bp, Homo sapiens; identical to SEQ ID NO: 9948

SEQ ID NO: 9985 - DNA, 201 bp, Homo sapiens; identical to SEQ ID NO: 9947

SEQ ID NO: 9986 - DNA, 201 bp, Homo sapiens; identical to SEQ ID NO: 9949

SEQ ID NO: 9987 - DNA, 201 bp, Homo sapiens; identical to SEQ ID NO: 9950

SEQ ID NO: 9988 - DNA, 201 bp, Homo sapiens; identical to SEQ ID NO: 9951

SEQ ID NO: 9989 - DNA, 201 bp, Homo sapiens; identical to SEQ ID NO: 9952

SEQ ID NO: 9990 - DNA, 201 bp, Homo sapiens; identical to SEQ ID NO: 9953

SEQ ID NO: 9991 - DNA, 201 bp, Homo sapiens; identical to SEQ ID NO: 9954

SEQ ID NO: 9992 - DNA, 201 bp, Homo sapiens
aaggtgatcggggagcaattggctttcctggaagtcgaggactcccaggatatgccggaaggccaggaaattctggaccaaaaggccagaaaggggaaaargggagtggaaacacattaactccatttacgaaagttcgactggtcggtgggagcggccctcacgaggggagagtggagatactccacagcggccagtggg

SEQ ID NO: 9993 - DNA, 201 bp, Homo sapiens; identical to SEQ ID NO: 9956

SEQ ID NO: 9994 - DNA, 201 bp, Homo sapiens; identical to SEQ ID NO: 9957

SEQ ID NO: 9995 - DNA, 201 bp, Homo sapiens; identical to SEQ ID NO: 9958

SEQ ID NO: 9996 - DNA, 201 bp, Homo sapiens
aggggaaaaggggagtggaaacacattaactccatttacgaaagttcgactggtcggtgggagcggccctcacgaggggagagtggagatactccacagcrgccagtggggtacaatttgtgacgatcgctgggaagtgcgcgttggacaggtcgtctgtaggagcttgggatacccaggtgttcaagccgtgcacaaggc

SEQ ID NO: 9997 - DNA, 201 bp, Homo sapiens; identical to SEQ ID NO: 9960

SEQ ID NO: 9998 - DNA, 201 bp, Homo sapiens; identical to SEQ ID NO: 9961

SEQ ID NO: 9999 - DNA, 201 bp, Homo sapiens; identical to SEQ ID NO: 9962

SEQ ID NO: 10000 - DNA, 201 bp, Homo sapiens; identical to SEQ ID NO: 9963

SEQ ID NO: 10001 - DNA, 201 bp, Homo sapiens; identical to SEQ ID NO: 9964

SEQ ID NO: 10002 - DNA, 201 bp, Homo sapiens; identical to SEQ ID NO: 9966

SEQ ID NO: 10003 - DNA, 201 bp, Homo sapiens; identical to SEQ ID NO: 9965

SEQ ID NO: 10004 - DNA, 201 bp, Homo sapiens; identical to SEQ ID NO: 9967

SEQ ID NO: 10005 - DNA, 201 bp, Homo sapiens; identical to SEQ ID NO: 9968

SEQ ID NO: 10006 - DNA, 201 bp, Homo sapiens; identical to SEQ ID NO: 9969

SEQ ID NO: 10007 - DNA, 201 bp, Homo sapiens; identical to SEQ ID NO: 9971

SEQ ID NO: 10008 - DNA, 201 bp, Homo sapiens; identical to SEQ ID NO: 9970

SEQ ID NO: 10009 - DNA, 201 bp, Homo sapiens; identical to SEQ ID NO: 9972

SEQ ID NO: 10010 - DNA, 201 bp, Homo sapiens; identical to SEQ ID NO: 9973

SEQ ID NO: 10011 - DNA, 201 bp, Homo sapiens; identical to SEQ ID NO: 9974

SEQ ID NO: 10012 - DNA, 201 bp, Homo sapiens; identical to SEQ ID NO: 9938

SEQ ID NO: 10013 - DNA, 201 bp, Homo sapiens; identical to SEQ ID NO: 9939

SEQ ID NO: 10014 - DNA, 201 bp, Homo sapiens; identical to SEQ ID NO: 9940

SEQ ID NO: 10015 - DNA, 201 bp, Homo sapiens; identical to SEQ ID NO: 9941

SEQ ID NO: 10016 - DNA, 201 bp, Homo sapiens; identical to SEQ ID NO: 9942

SEQ ID NO: 10017 - DNA, 201 bp, Homo sapiens; identical to SEQ ID NO: 9943

SEQ ID NO: 10018 - DNA, 201 bp, Homo sapiens; identical to SEQ ID NO: 9945

SEQ ID NO: 10019 - DNA, 201 bp, Homo sapiens; identical to SEQ ID NO: 9946

SEQ ID NO: 10020 - DNA, 201 bp, Homo sapiens; identical to SEQ ID NO: 9947

SEQ ID NO: 10021 - DNA, 201 bp, Homo sapiens; identical to SEQ ID NO: 9948

SEQ ID NO: 10022 - DNA, 201 bp, Homo sapiens; identical to SEQ ID NO: 9949

SEQ ID NO: 10023 - DNA, 201 bp, Homo sapiens; identical to SEQ ID NO: 9950

SEQ ID NO: 10024 - DNA, 201 bp, Homo sapiens; identical to SEQ ID NO: 9951

SEQ ID NO: 10025 - DNA, 201 bp, Homo sapiens; identical to SEQ ID NO: 9952

SEQ ID NO: 10026 - DNA, 201 bp, Homo sapiens; identical to SEQ ID NO: 9953

SEQ ID NO: 10027 - DNA, 201 bp, Homo sapiens; identical to SEQ ID NO: 9954

SEQ ID NO: 10028 - DNA, 201 bp, Homo sapiens
aaggtgatcggggagcaattggctttcctggaagtcgaggactcccaggatatgccggaaggccaggaaattctggaccaaaaggccagaaaggggaaaargggagtggaaacacattaagtactggtccaatatggctgaatgaagtgttttgttttgggagagaatcatctattgaagaatgtaaaattcggcaatggg

SEQ ID NO: 10029 - DNA, 201 bp, Homo sapiens; identical to SEQ ID NO: 9956

SEQ ID NO: 10030 - DNA, 201 bp, Homo sapiens; identical to SEQ ID NO: 9957

SEQ ID NO: 10031 - DNA, 201 bp, Homo sapiens; identical to SEQ ID NO: 9958

SEQ ID NO: 10032 - DNA, 201 bp, Homo sapiens
agtactggtccaatatggctgaatgaagtgttttgttttgggagagaatcatctattgaagaatgtaaaattcggcaatgggggacaagagcctgttcacrttctgaagatgctggagtcacttgcactttataatgcatcatattttcattcacaactatgaaatcgctgctcaaaaatgattttattaccttgttcctg

SEQ ID NO: 10033 - DNA, 201 bp, Homo sapiens; identical to SEQ ID NO: 9961

SEQ ID NO: 10034 - DNA, 201 bp, Homo sapiens; identical to SEQ ID NO: 9962

SEQ ID NO: 10035 - DNA, 201 bp, Homo sapiens; identical to SEQ ID NO: 9963

SEQ ID NO: 10036 - DNA, 201 bp, Homo sapiens; identical to SEQ ID NO: 9964

SEQ ID NO: 10037 - DNA, 201 bp, Homo sapiens; identical to SEQ ID NO: 9965

SEQ ID NO: 10038 - DNA, 201 bp, Homo sapiens; identical to SEQ ID NO: 9966

SEQ ID NO: 10039 - DNA, 201 bp, Homo sapiens; identical to SEQ ID NO: 9967

SEQ ID NO: 10040 - DNA, 201 bp, Homo sapiens; identical to SEQ ID NO: 9968

SEQ ID NO: 10041 - DNA, 201 bp, Homo sapiens; identical to SEQ ID NO: 9969

SEQ ID NO: 10042 - DNA, 201 bp, Homo sapiens; identical to SEQ ID NO: 9970

SEQ ID NO: 10043 - DNA, 201 bp, Homo sapiens; identical to SEQ ID NO: 9971

SEQ ID NO: 10044 - DNA, 201 bp, Homo sapiens; identical to SEQ ID NO: 9972

SEQ ID NO: 10045 - DNA, 201 bp, Homo sapiens; identical to SEQ ID NO: 9973

SEQ ID NO: 10046 - DNA, 201 bp, Homo sapiens; identical to SEQ ID NO: 9974

SEQ ID NO: 10047 - DNA, 201 bp, Homo sapiens; identical to SEQ ID NO: 9938

SEQ ID NO: 10048 - DNA, 201 bp, Homo sapiens; identical to SEQ ID NO: 9939

SEQ ID NO: 10049 - DNA, 201 bp, Homo sapiens; identical to SEQ ID NO: 9940

SEQ ID NO: 10050 - DNA, 121 bp, Homo sapiens
cattgatgagagtgctattgraacacattaagaaagattttcaacgcaggaatgtgtcatttcctttcttcatgtaccagatgctgaaatactatgagataaagattttaggtttcaattg

SEQ ID NO: 10051 - DNA, 201 bp, Homo sapiens; identical to SEQ ID NO: 9941

SEQ ID NO: 10052 - DNA, 137 bp, Homo sapiens
cattgatgagagtgctattgaaacacattaagaaagrttttcaacgcaggaatgtgtcatttcctttcttcatgtaccagatgctgaaatactatgagataaagattttaggtttcaattgtaaagagagagaagtg

SEQ ID NO: 10053 - DNA, 201 bp, Homo sapiens; identical to SEQ ID NO: 9942

SEQ ID NO: 10054 - DNA, 201 bp, Homo sapiens; identical to SEQ ID NO: 9944

SEQ ID NO: 10055 - DNA, 201 bp, Homo sapiens; identical to SEQ ID NO: 9943

SEQ ID NO: 10056 - DNA, 201 bp, Homo sapiens; identical to SEQ ID NO: 9945

SEQ ID NO: 10057 - DNA, 201 bp, Homo sapiens; identical to SEQ ID NO: 9946

SEQ ID NO: 10058 - DNA, 201 bp, Homo sapiens; identical to SEQ ID NO: 9948

SEQ ID NO: 10059 - DNA, 201 bp, Homo sapiens; identical to SEQ ID NO: 9947

SEQ ID NO: 10060 - DNA, 201 bp, Homo sapiens; identical to SEQ ID NO: 9949

SEQ ID NO: 10061 - DNA, 201 bp, Homo sapiens
caacgcaggaatgtgtcatttcctttcttcatgtaccagatgctgaaatactatgagataaagattttaggtttcaattgtaaagagagagaagtggataratcagtgctgctttctttaggacgaaagaagtatggagcagtgggatcactttcacaatcaacaggaggacactgatagctgctccgaatctgtgaaatt

SEQ ID NO: 10062 - DNA, 201 bp, Homo sapiens; identical to SEQ ID NO: 9950

SEQ ID NO: 10063 - DNA, 201 bp, Homo sapiens; identical to SEQ ID NO: 9951

SEQ ID NO: 10064 - DNA, 201 bp, Homo sapiens; identical to SEQ ID NO: 9952

SEQ ID NO: 10065 - DNA, 201 bp, Homo sapiens; identical to SEQ ID NO: 9953

SEQ ID NO: 10066 - DNA, 201 bp, Homo sapiens; identical to SEQ ID NO: 9954

SEQ ID NO: 10067 - DNA, 201 bp, Homo sapiens; identical to SEQ ID NO: 9955

SEQ ID NO: 10068 - DNA, 201 bp, Homo sapiens; identical to SEQ ID NO: 9956

SEQ ID NO: 10069 - DNA, 201 bp, Homo sapiens; identical to SEQ ID NO: 9957

SEQ ID NO: 10070 - DNA, 201 bp, Homo sapiens; identical to SEQ ID NO: 9958

SEQ ID NO: 10071 - DNA, 201 bp, Homo sapiens; identical to SEQ ID NO: 9959

SEQ ID NO: 10072 - DNA, 201 bp, Homo sapiens; identical to SEQ ID NO: 9960

SEQ ID NO: 10073 - DNA, 201 bp, Homo sapiens; identical to SEQ ID NO: 9961

SEQ ID NO: 10074 - DNA, 201 bp, Homo sapiens; identical to SEQ ID NO: 9962

SEQ ID NO: 10075 - DNA, 201 bp, Homo sapiens; identical to SEQ ID NO: 9963

SEQ ID NO: 10076 - DNA, 201 bp, Homo sapiens; identical to SEQ ID NO: 9964

SEQ ID NO: 10077 - DNA, 201 bp, Homo sapiens; identical to SEQ ID NO: 9966

SEQ ID NO: 10078 - DNA, 201 bp, Homo sapiens; identical to SEQ ID NO: 9965

SEQ ID NO: 10079 - DNA, 201 bp, Homo sapiens; identical to SEQ ID NO: 9967

SEQ ID NO: 10080 - DNA, 201 bp, Homo sapiens; identical to SEQ ID NO: 9968

SEQ ID NO: 10081 - DNA, 201 bp, Homo sapiens; identical to SEQ ID NO: 9969

SEQ ID NO: 10082 - DNA, 201 bp, Homo sapiens; identical to SEQ ID NO: 9971

SEQ ID NO: 10083 - DNA, 201 bp, Homo sapiens; identical to SEQ ID NO: 9970

SEQ ID NO: 10084 - DNA, 201 bp, Homo sapiens; identical to SEQ ID NO: 9972

SEQ ID NO: 10085 - DNA, 201 bp, Homo sapiens; identical to SEQ ID NO: 9973

SEQ ID NO: 10086 - DNA, 201 bp, Homo sapiens; identical to SEQ ID NO: 9974

SEQ ID NO: 10087 - DNA, 201 bp, Homo sapiens
ttctattgcacaggctggactacacgcattcacctagagtctagaacacaatttaatttattgggttctaggagaactgtcatgagtattgataatatgaragttctttatattcaaacattattctcaaccagagatagggatgtcatagaagaaaatccattcattcaatcattaattcacatgtccattatgtacctc

SEQ ID NO: 10088 - DNA, 201 bp, Homo sapiens
gagctggacataacagctaataagagataattgtctctggttttacagagctaattgtccctaagagatgtagacaaatgaacaagcaattacaatacatytaagctatactgggggaggaacagggctggataggtatgcagaggagataaaaaaattttaattccttagaatattttttaaaaattgattcttatttta

SEQ ID NO: 10089 - DNA, 201 bp, Homo sapiens
tcttctttcctttacgttttaacacacagacccaagattcatactattaagattctagtagaactctagatggtatgcctctgtgtatctcagcatttttrttcccactcttgtataatgaacatgttaacacctacctcacagggttgttgtgaggatcaagtaagatattgtgtgtgtgaagatgctctgtgaaatcat

SEQ ID NO: 10090 - DNA, 201 bp, Homo sapiens
gatcaaagtaaagactgagtcaagggctttttttttttctttttcttgttttaagagacagagccttgttctattgcacaggctggactacacgcattcamctagagtctagaacacaatttaatttattgggttctaggagaactgtcatgagtattgataatatgagagttctttatattcaaacattattctcaacca

SEQ ID NO: 10091 - DNA, 201 bp, Homo sapiens; identical to SEQ ID NO: 9954

SEQ ID NO: 10092 - DNA, 201 bp, Homo sapiens; identical to SEQ ID NO: 9956

SEQ ID NO: 10093 - DNA, 201 bp, Homo sapiens; identical to SEQ ID NO: 9955

SEQ ID NO: 10094 - DNA, 201 bp, Homo sapiens; identical to SEQ ID NO: 9957

SEQ ID NO: 10095 - DNA, 201 bp, Homo sapiens
ctctcatgcacggactggagggctgctccaaccagtcctcagttctctgccacccattgacctagagtcttgaacccaatttaatttattgggttctaggrgaactgctgtgttctcaccctaacttggaagagtgatgtttcagtcaagcaaagcgattcctaccatacaatataacacttgtgtgaggctctgtcctaa

SEQ ID NO: 10096 - DNA, 201 bp, Homo sapiens; identical to SEQ ID NO: 9958

SEQ ID NO: 10097 - DNA, 201 bp, Homo sapiens; identical to SEQ ID NO: 9939

SEQ ID NO: 10098 - DNA, 201 bp, Homo sapiens
acagcatatatatatatttttttaagttttgaagtgtagtcgagcttgggcaatttatccaacccatttaaaccaaaaataaaacttttcatgtattaccyggtcatttcaaacaaaaatattttgatcatgaaaaagaataccaatattcttttgttctaaaaatctcttatgggattacatgttatatttttggtttct

SEQ ID NO: 10099 - DNA, 201 bp, Homo sapiens
aatgaatactggtctctttccaaagcatttttgatcaaagtaaagactgagtcaagggctttttttttttctttttcttgttttaagagacagagccttgytctattgcacaggctggactacacgcattcacctagagtctagaacacaatttaatttattgggttctaggagaactgtcatgagtattgataatatgag

SEQ ID NO: 10100 - DNA, 201 bp, Homo sapiens; identical to SEQ ID NO: 9940

SEQ ID NO: 10101 - DNA, 201 bp, Homo sapiens; identical to SEQ ID NO: 9941

SEQ ID NO: 10102 - DNA, 121 bp, Homo sapiens; identical to SEQ ID NO: 10050

SEQ ID NO: 10103 - DNA, 137 bp, Homo sapiens; identical to SEQ ID NO: 10052

SEQ ID NO: 10104 - DNA, 201 bp, Homo sapiens; identical to SEQ ID NO: 9947

SEQ ID NO: 10105 - DNA, 201 bp, Homo sapiens; identical to SEQ ID NO: 10061

SEQ ID NO: 10106 - DNA, 201 bp, Homo sapiens; identical to SEQ ID NO: 9949

SEQ ID NO: 10107 - DNA, 201 bp, Homo sapiens
atataacacttgtgtgaggctctgtcctaaatatctcaattaccaatatgtggtttggtagtatttctcgccatgctttgctcatgcgcaatgagactacmactagggtgtaaattttaagtatcccatctaaaactcatacaatgataggaaaaatccatttgtttttcatttgatttttactgaggaatcagctcaatc

SEQ ID NO: 10108 - DNA, 201 bp, Homo sapiens; identical to SEQ ID NO: 9973

SEQ ID NO: 10109 - DNA, 201 bp, Homo sapiens; identical to SEQ ID NO: 9974

SEQ ID NO: 10110 - DNA, 201 bp, Homo sapiens
acttcagcgggccctgcgactccaagatgaaacccgaccgcctcaactactgccgccacgtgctggccgcctgggccctgggtgccaaggcattttactayccagaggaagccggccttgccttcgggggtccagggtcctccagatatctccgcctggaagttcactaccacaacccactggtgatagaaggacgaaacg

SEQ ID NO: 10111 - DNA, 201 bp, Homo sapiens
caagaggccctttggcacctgcgaccccaaggattacctcattgaagacggcactgtccacttggtctacgggatcctggaggagccgttccggtcactgsaggccatcaacggctcgggcctgcagatggggctgcagagggtgcagctcctgaagcccaatatccccgaaccggagttgccctcagacgcgtgcaccat

SEQ ID NO: 10112 - DNA, 201 bp, Homo sapiens
ccggtcactggaggccatcaacggctcgggcctgcagatggggctgcagagggtgcagctcctgaagcccaatatccccgaaccggagttgccctcagacrcgtgcaccatggaggtccaagctcccaatatccagatccccagccaggagaccacgtactggtgctacattaaggagcttccaaagggcttctctcggca

SEQ ID NO: 10113 - DNA, 201 bp, Homo sapiens
cttccacctcatcaacaggttcaacaacgaggatgtctgcacctgccctcaggcgtccgtgtctcagcagttcacctctgttccctggaactccttcaacygcgacgtactgaaggccctgtacagcttcgcgcccatctccatgcactgcaacaagtcctcagccgtccgcttccagggtgaatggaacctgcagcccct

SEQ ID NO: 10114 - DNA, 201 bp, Homo sapiens
aggggggacctactcctccccctcctccatgctgtccctgtgggctcacaccggcactgtgcactctactctgcgacgatccccatggaacagccctgcaygcccaggatgaaggggccagaccacgcccctgcctgagaccacggtccaatccagccttcttcccccagggtcccctgcatggctgagagggtgtgggtg

SEQ ID NO: 10115 - DNA, 201 bp, Homo sapiens
agttgccctcagacgcgtgcaccatggaggtccaagctcccaatatccagatccccagccaggagaccacgtactggtgctacattaaggagcttccaaasggcttctctcggcaccacattatcaagtacgagcccatcgtcaccaagggcaatgaggcccttgtccaccacatggaagtcttccagtgcgcccccgaga

SEQ ID NO: 10116 - DNA, 201 bp, Homo sapiens
gcaccatggaggtccaagctcccaatatccagatccccagccaggagaccacgtactggtgctacattaaggagcttccaaagggcttctctcggcaccayattatcaagtacgagcccatcgtcaccaagggcaatgaggcccttgtccaccacatggaagtcttccagtgcgcccccgagatggacagcgtcccccact

SEQ ID NO: 10117 - DNA, 201 bp, Homo sapiens
ctccttcaaccgcgacgtactgaaggccctgtacagcttcgcgcccatctccatgcactgcaacaagtcctcagccgtccgcttccagggtgaatggaacytgcagcccctgcccaaggtcatctccacactggaagagcccaccccacagtgccccaccagccagggccgaagccctgctggccccaccgttgtcagcat

SEQ ID NO: 10118 - DNA, 201 bp, Homo sapiens
ccaagctcccaatatccagatccccagccaggagaccacgtactggtgctacattaaggagcttccaaagggcttctctcggcaccacattatcaagtacsagcccatcgtcaccaagggcaatgaggcccttgtccaccacatggaagtcttccagtgcgcccccgagatggacagcgtcccccacttcagcgggccctg

SEQ ID NO: 10119 - DNA, 143 bp, Homo sapiens
accccagccatgcccgccctcagtcgctgggccagcctgcccrgccccagcatgcgggaggcagccttcatgtacagcacagcagtggccatcttcctggtcatcctggtggccgcactgcagggctcggctccccgtgagag

SEQ ID NO: 10120 - DNA, 201 bp, Homo sapiens
caatgaggcccttgtccaccacatggaagtcttccagtgcgcccccgagatggacagcgtcccccacttcagcgggccctgcgactccaagatgaaacccraccgcctcaactactgccgccacgtgctggccgcctgggccctgggtgccaaggcattttactacccagaggaagccggccttgccttcgggggtccagg

SEQ ID NO: 10121 - DNA, 201 bp, Homo sapiens
aacaacgaggatgtctgcacctgccctcaggcgtccgtgtctcagcagttcacctctgttccctggaactccttcaaccgcgacgtactgaaggccctgtrcagcttcgcgcccatctccatgcactgcaacaagtcctcagccgtccgcttccagggtgaatggaacctgcagcccctgcccaaggtcatctccacactg

SEQ ID NO: 10122 - DNA, 201 bp, Homo sapiens
tccaagctcccaatatccagatccccagccaggagaccacgtactggtgctacattaaggagcttccaaagggcttctctcggcaccacattatcaagtaygagcccatcgtcaccaagggcaatgaggcccttgtccaccacatggaagtcttccagtgcgcccccgagatggacagcgtcccccacttcagcgggccct

SEQ ID NO: 10123 - DNA, 201 bp, Homo sapiens
ccggaggggtccctggagctctcatggaatgtcagctacacccaggaggccatccatttccagctcctggtgcggaggctcaaggctggcgtcctgtttgsgatgtccgaccgtggcgagcttgagaacgcagatctcgtggtgctctggaccgatggggacactgcctattttgcggacgcctggagtgaccagaagggg

SEQ ID NO: 10124 - DNA, 201 bp, Homo sapiens
gactccaagatgaaacccgaccgcctcaactactgccgccacgtgctggccgcctgggccctgggtgccaaggcattttactacccagaggaagccggccytgccttcgggggtccagggtcctccagatatctccgcctggaagttcactaccacaacccactggtgatagaaggacgaaacgactcctcaggcatccgc

SEQ ID NO: 10125 - DNA, 201 bp, Homo sapiens
ctccaagatgaaacccgaccgcctcaactactgccgccacgtgctggccgcctgggccctgggtgccaaggcattttactacccagaggaagccggccttkccttcgggggtccagggtcctccagatatctccgcctggaagttcactaccacaacccactggtgatagaaggacgaaacgactcctcaggcatccgctt

SEQ ID NO: 10126 - DNA, 201 bp, Homo sapiens
aggctgaggggggacctactcctccccctcctccatgctgtccctgtgggctcacaccggcactgtgcactctactctgcgacgatccccatggaacagcmctgcacgcccaggatgaaggggccagaccacgcccctgcctgagaccacggtccaatccagccttcttcccccagggtcccctgcatggctgagagggtg

SEQ ID NO: 10127 - DNA, 201 bp, Homo sapiens
gagcttccaaagggcttctctcggcaccacattatcaagtacgagcccatcgtcaccaagggcaatgaggcccttgtccaccacatggaagtcttccagtkcgcccccgagatggacagcgtcccccacttcagcgggccctgcgactccaagatgaaacccgaccgcctcaactactgccgccacgtgctggccgcctgg

SEQ ID NO: 10128 - DNA, 201 bp, Homo sapiens
catttccagctcctggtgcggaggctcaaggctggcgtcctgtttgggatgtccgaccgtggcgagcttgagaacgcagatctcgtggtgctctggaccgmtggggacactgcctattttgcggacgcctggagtgaccagaaggggcagatccacctggatccccagcaggactaccagctgctgcaggtgcagaggacc

SEQ ID NO: 10129 - DNA, 201 bp, Homo sapiens
actccttcaaccgcgacgtactgaaggccctgtacagcttcgcgcccatctccatgcactgcaacaagtcctcagccgtccgcttccagggtgaatggaayctgcagcccctgcccaaggtcatctccacactggaagagcccaccccacagtgccccaccagccagggccgaagccctgctggccccaccgttgtcagca

SEQ ID NO: 10130 - DNA, 155 bp, Homo sapiens
accccagccatgcccgccctcagtcgctgggccagcctgcccggccccagcatgygggaggcagccttcatgtacagcacagcagtggccatcttcctggtcatcctggtggccgcactgcagggctcggctccccgtgagagccccctccccta

SEQ ID NO: 10131 - DNA, 201 bp, Homo sapiens
gtgaaccaggacaatcactacagccctcacttccaggagatccgcatgttgaagaaggtcgtgtcggtccatccgggagatgtgctcatcacctcctgcaygtacaacacggaagaccgggagctggccacagtggggggcttcgggatcctggaggagatgtgtgtcaactacgtgcactactacccccagacgcagctg

SEQ ID NO: 10132 - DNA, 201 bp, Homo sapiens
aggactaccagctgctgcaggtgcagaggaccccagaaggcctgaccctgcttttcaagaggccctttggcacctgcgaccccaaggattacctcattgargacggcactgtccacttggtctacgggatcctggaggagccgttccggtcactggaggccatcaacggctcgggcctgcagatggggctgcagagggtgc

SEQ ID NO: 10133 - DNA, 201 bp, Homo sapiens
gcatggctgagagggtgtgggtgccctgttgacctaccctggaccgagtggaccacgacctcgtccatttaaacccggctgactcagtgcagggacagccygcacagtggtccagggtccagccctccgccagccctgttccgcctcactgggtgtggcctggcttctgggacaggcaccatgctgggccggggtgtggaa

SEQ ID NO: 10134 - DNA, 201 bp, Homo sapiens
cagggtccagccctccgccagccctgttccgcctcactgggtgtggcctggcttctgggacaggcaccatgctgggccggggtgtggaatcaccgggaacrcccccgcccccgccccgctgctcccggtgtgcagcgggtgcgggtgccgcttaaacatttccctgctgagtggctcgtgtttcacagtgggcggcttccc

SEQ ID NO: 10135 - DNA, 201 bp, Homo sapiens
gcccatcgtcaccaagggcaatgaggcccttgtccaccacatggaagtcttccagtgcgcccccgagatggacagcgtcccccacttcagcgggccctgcractccaagatgaaacccgaccgcctcaactactgccgccacgtgctggccgcctgggccctgggtgccaaggcattttactacccagaggaagccggcct

SEQ ID NO: 10136 - DNA, 176 bp, Homo sapiens
atgccgtgcgggctaatgagccaataaagctcacacttgggctggcacccactggaggtgggtatgtttgcactccgggccgtcgctccaggagagagaascttgctcctgagcctcctccctgtgccaggcgtggtaccaagtgcttccccctgagcgtcctgaagctgcctcag

SEQ ID NO: 10137 - DNA, 201 bp, Homo sapiens
acaatcactacagccctcacttccaggagatccgcatgttgaagaaggtcgtgtcggtccatccgggagatgtgctcatcacctcctgcacgtacaacacrgaagaccgggagctggccacagtggggggcttcgggatcctggaggagatgtgtgtcaactacgtgcactactacccccagacgcagctggagctctgca

SEQ ID NO: 10138 - DNA, 201 bp, Homo sapiens
ttcctgcagaagtacttccacctcatcaacaggttcaacaacgaggatgtctgcacctgccctcaggcgtccgtgtctcagcagttcacctctgttccctsgaactccttcaaccgcgacgtactgaaggccctgtacagcttcgcgcccatctccatgcactgcaacaagtcctcagccgtccgcttccagggtgaatgg

SEQ ID NO: 10139 - DNA, 201 bp, Homo sapiens
tgcactgcaacaagtcctcagccgtccgcttccagggtgaatggaacctgcagcccctgcccaaggtcatctccacactggaagagcccaccccacagtgycccaccagccagggccgaagccctgctggccccaccgttgtcagcattggtgggggcaaaggctgaggggggacctactcctccccctcctccatgctgt

SEQ ID NO: 10140 - DNA, 201 bp, Homo sapiens
tcaaggctggcgtcctgtttgggatgtccgaccgtggcgagcttgagaacgcagatctcgtggtgctctggaccgatggggacactgcctattttgcggamgcctggagtgaccagaaggggcagatccacctggatccccagcaggactaccagctgctgcaggtgcagaggaccccagaaggcctgaccctgcttttca

SEQ ID NO: 10141 - DNA, 201 bp, Homo sapiens
actcagggaccagaaggcggctgcaggacgcgaccgagcaggaccccaggcccgggaacgacgtcgcgagcgctgagactgccgggcctcccagcccatcwggcattcgagcgcaggaccgggcgccccggcaccgccgcgcgccacccgctaggatgccggtggccccagcgccctcagccgacggaggagccctttttc

SEQ ID NO: 10142 - DNA, 201 bp, Homo sapiens
ccatcgagcggcacttgacaatgatcaaaatgaggccttacgacgccaacaagaggcaccgcgtcttcctcctgatcgggatgtgctggctcattgccttyacgctgggcgccctgcccattctgggctggaactgcctgcacaatctccctgactgctctaccatcctgcccctctactccaagaagtacattgccttct

SEQ ID NO: 10143 - DNA, 201 bp, Homo sapiens
atcgagcggcacttgacaatgatcaaaatgaggccttacgacgccaacaagaggcaccgcgtcttcctcctgatcgggatgtgctggctcattgccttcaygctgggcgccctgcccattctgggctggaactgcctgcacaatctccctgactgctctaccatcctgcccctctactccaagaagtacattgccttctgc

SEQ ID NO: 10144 - DNA, 201 bp, Homo sapiens
actgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcgga

SEQ ID NO: 10145 - DNA, 201 bp, Homo sapiens
accatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatc

SEQ ID NO: 10146 - DNA, 201 bp, Homo sapiens
cacaaacccaccaaggtgctctcccccgagtacttgtgggaccagcagctgctgggctggcccgccgtcctgaggaagctgaggttcactgcggtgcccawgaaccaccaggcggtcccggaacccgtgagcggctgccaggggctctgggagggctgccggcagccccgtccccctcccgcccttggttttagcagaacg

SEQ ID NO: 10147 - DNA, 201 bp, Homo sapiens
gtccactactatgtcttcaccgaccagccggccgcggtgccccgcgtgacgctggggaccggtcggcagctgtcagtgctggaggtgcgcgcctacaagcrctggcaggacgtgtccatgcgccgcatggagatgatcagtgacttctgcgagcggcgcttcctcagcgaggtggattacctggtgtgcgtggacgtggac

SEQ ID NO: 10148 - DNA, 201 bp, Homo sapiens
ggggttctgcatggctgttagggaacctgaccatctgcagcgcgtctcgttgccaaggatggtctacccccagccaaaggtgctgacaccgtgtaggaagkatgtcctcgtggtgaccccttggctggctcccattgtctgggagggcacattcaacatcgacatcctcaacgagcagttcaggctccagaacaccaccat

SEQ ID NO: 10149 - DNA, 201 bp, Homo sapiens
ggagacggcggagaagcacttcatggtgggccaccgtgtccactactatgtcttcaccgaccagccggccgcggtgccccgcgtgacgctggggaccggtbggcagctgtcagtgctggaggtgcgcgcctacaagcgctggcaggacgtgtccatgcgccgcatggagatgatcagtgacttctgcgagcggcgcttcct

SEQ ID NO: 10150 - DNA, 201 bp, Homo sapiens
ggtgggccaccgtgtccactactatgtcttcaccgaccagccggccgcggtgccccgcgtgacgctggggaccggtcggcagctgtcagtgctggaggtgsgcgcctacaagcgctggcaggacgtgtccatgcgccgcatggagatgatcagtgacttctgcgagcggcgcttcctcagcgaggtggattacctggtgtg

SEQ ID NO: 10151 - DNA, 201 bp, Homo sapiens
tgcgccgcatggagatgatcagtgacttctgcgagcggcgcttcctcagcgaggtggattacctggtgtgcgtggacgtggacatggagttccgcgaccaygtgggcgtggagatcctgactccgctgttcggcaccctgcaccccggcttctacggaagcagccgggaggccttcacctacgagcgccggccccagtccc

SEQ ID NO: 10152 - DNA, 201 bp, Homo sapiens
ctgaagctgttcctggagacggcggagaagcacttcatggtgggccaccgtgtccactactatgtcttcaccgaccagccggccgcggtgccccgcgtgaygctggggaccggtcggcagctgtcagtgctggaggtgcgcgcctacaagcgctggcaggacgtgtccatgcgccgcatggagatgatcagtgacttctgc

SEQ ID NO: 10153 - DNA, 201 bp, Homo sapiens
tcttgtttggttacggggtcctaagccccagaagtctaatgccaggaagcctggaacgggggttctgcatggctgttagggaacctgaccatctgcagcgygtctcgttgccaaggatggtctacccccagccaaaggtgctgacaccgtgtaggaaggatgtcctcgtggtgaccccttggctggctcccattgtctggg

SEQ ID NO: 10154 - DNA, 201 bp, Homo sapiens
gtcttgtttggttacggggtcctaagccccagaagtctaatgccaggaagcctggaacgggggttctgcatggctgttagggaacctgaccatctgcagcrcgtctcgttgccaaggatggtctacccccagccaaaggtgctgacaccgtgtaggaaggatgtcctcgtggtgaccccttggctggctcccattgtctgg

SEQ ID NO: 10155 - DNA, 201 bp, Homo sapiens
tttagcagaacgggtaaactctgtttcctttgtccgtcctgttgtgagtaactgaagcctaggccccgtccccacctcaaatcacacacaccccctccccrccacagagacaccattacatacacagacacacacagaaagacacacacagacacaaaatcacacacacaccctccccgccacagagacaccattacatac

SEQ ID NO: 10156 - DNA, 201 bp, Homo sapiens
cgagcgccggccccagtcccaggcctacatccccaaggacgagggcgatttctactacctgggggggttcttcggggggtcggtgcaagaggtgcagcggytcaccagggcctgccaccaggccatgatggtcgaccaggccaacggcatcgaggccgtgtggcacgacgagagccacctgaacaagtacctgctgcgcca

SEQ ID NO: 10157 - DNA, 201 bp, Homo sapiens
ggacgtgtccatgcgccgcatggagatgatcagtgacttctgcgagcggcgcttcctcagcgaggtggattacctggtgtgcgtggacgtggacatggagwtccgcgaccacgtgggcgtggagatcctgactccgctgttcggcaccctgcaccccggcttctacggaagcagccgggaggccttcacctacgagcgccg

SEQ ID NO: 10158 - DNA, 201 bp, Homo sapiens
tgcagcggctcaccagggcctgccaccaggccatgatggtcgaccaggccaacggcatcgaggccgtgtggcacgacgagagccacctgaacaagtacctrctgcgccacaaacccaccaaggtgctctcccccgagtacttgtgggaccagcagctgctgggctggcccgccgtcctgaggaagctgaggttcactgcgg

SEQ ID NO: 10159 - DNA, 201 bp, Homo sapiens
gctttcctgaagctgttcctggagacggcggagaagcacttcatggtgggccaccgtgtccactactatgtcttcaccgaccagccggccgcggtgccccrcgtgacgctggggaccggtcggcagctgtcagtgctggaggtgcgcgcctacaagcgctggcaggacgtgtccatgcgccgcatggagatgatcagtgac

SEQ ID NO: 10160 - DNA, 201 bp, Homo sapiens
tggacgtggacatggagttccgcgaccacgtgggcgtggagatcctgactccgctgttcggcaccctgcaccccggcttctacggaagcagccgggaggcyttcacctacgagcgccggccccagtcccaggcctacatccccaaggacgagggcgatttctactacctgggggggttcttcggggggtcggtgcaagagg

SEQ ID NO: 10161 - DNA, 201 bp, Homo sapiens
agatcctgactccgctgttcggcaccctgcaccccggcttctacggaagcagccgggaggccttcacctacgagcgccggccccagtcccaggcctacatmcccaaggacgagggcgatttctactacctgggggggttcttcggggggtcggtgcaagaggtgcagcggctcaccagggcctgccaccaggccatgatgg

SEQ ID NO: 10162 - DNA, 201 bp, Homo sapiens
ggtgtgcgtggacgtggacatggagttccgcgaccacgtgggcgtggagatcctgactccgctgttcggcaccctgcaccccggcttctacggaagcagcygggaggccttcacctacgagcgccggccccagtcccaggcctacatccccaaggacgagggcgatttctactacctgggggggttcttcggggggtcggt

SEQ ID NO: 10163 - DNA, 201 bp, Homo sapiens
tgccaaggatggtctacccccagccaaaggtgctgacaccgtgtaggaaggatgtcctcgtggtgaccccttggctggctcccattgtctgggagggcacrttcaacatcgacatcctcaacgagcagttcaggctccagaacaccaccattgggttaactgtgtttgccatcaagaaatacgtggctttcctgaagctgt

SEQ ID NO: 10164 - DNA, 201 bp, Homo sapiens
taaactctgtttcctttgtccgtcctgttgtgagtaactgaagcctaggccccgtccccacctcaaatcacacacaccccctccccaccacagagacaccrttacatacacagacacacacagaaagacacacacagacacaaaatcacacacacaccctccccgccacagagacaccattacatacacagacacacacag

SEQ ID NO: 10165 - DNA, 201 bp, Homo sapiens
aagtctaatgccaggaagcctggaacgggggttctgcatggctgttagggaacctgaccatctgcagcgcgtctcgttgccaaggatggtctacccccagycaaaggtgctgacaccgtgtaggaaggatgtcctcgtggtgaccccttggctggctcccattgtctgggagggcacattcaacatcgacatcctcaacga

SEQ ID NO: 10166 - DNA, 201 bp, Homo sapiens
gaggttcactgcggtgcccaagaaccaccaggcggtcccggaacccgtgagcggctgccaggggctctgggagggctgccggcagccccgtccccctcccrcccttggttttagcagaacgggtaaactctgtttcctttgtccgtcctgttgtgagtaactgaagcctaggccccgtccccacctcaaatcacacacacc

SEQ ID NO: 10167 - DNA, 201 bp, Homo sapiens
agccaaaggtgctgacaccgtgtaggaaggatgtcctcgtggtgaccccttggctggctcccattgtctgggagggcacattcaacatcgacatcctcaaygagcagttcaggctccagaacaccaccattgggttaactgtgtttgccatcaagaaatacgtggctttcctgaagctgttcctggagacggcggagaagc

SEQ ID NO: 10168 - DNA, 201 bp, Homo sapiens
tacatccccaaggacgagggcgatttctactacctgggggggttcttcggggggtcggtgcaagaggtgcagcggctcaccagggcctgccaccaggccakgatggtcgaccaggccaacggcatcgaggccgtgtggcacgacgagagccacctgaacaagtacctgctgcgccacaaacccaccaaggtgctctccccc

SEQ ID NO: 10169 - DNA, 157 bp, Homo sapiens
agacgcggagccatggccgaggtgttgcggacgctggccggaaaaccaaaatgccaygcacttcgacctatgatccttttcctaataatgcttgtcttggtcttgtttggttacggggtcctaagccccagaagtctaatgccaggaagcctggaac

SEQ ID NO: 10170 - DNA, 201 bp, Homo sapiens
tggcaggacgtgtccatgcgccgcatggagatgatcagtgacttctgcgagcggcgcttcctcagcgaggtggattacctggtgtgcgtggacgtggacakggagttccgcgaccacgtgggcgtggagatcctgactccgctgttcggcaccctgcaccccggcttctacggaagcagccgggaggccttcacctacgag

SEQ ID NO: 10171 - DNA, 201 bp, Homo sapiens
acttctgcgagcggcgcttcctcagcgaggtggattacctggtgtgcgtggacgtggacatggagttccgcgaccacgtgggcgtggagatcctgactccrctgttcggcaccctgcaccccggcttctacggaagcagccgggaggccttcacctacgagcgccggccccagtcccaggcctacatccccaaggacgagg

SEQ ID NO: 10172 - DNA, 201 bp, Homo sapiens
agatgatcagtgacttctgcgagcggcgcttcctcagcgaggtggattacctggtgtgcgtggacgtggacatggagttccgcgaccacgtgggcgtggakatcctgactccgctgttcggcaccctgcaccccggcttctacggaagcagccgggaggccttcacctacgagcgccggccccagtcccaggcctacatcc

SEQ ID NO: 10173 - DNA, 201 bp, Homo sapiens
cctcagcgaggtggattacctggtgtgcgtggacgtggacatggagttccgcgaccacgtgggcgtggagatcctgactccgctgttcggcaccctgcacbccggcttctacggaagcagccgggaggccttcacctacgagcgccggccccagtcccaggcctacatccccaaggacgagggcgatttctactacctggg

SEQ ID NO: 10174 - DNA, 201 bp, Homo sapiens
ggggaccggtcggcagctgtcagtgctggaggtgcgcgcctacaagcgctggcaggacgtgtccatgcgccgcatggagatgatcagtgacttctgcgagyggcgcttcctcagcgaggtggattacctggtgtgcgtggacgtggacatggagttccgcgaccacgtgggcgtggagatcctgactccgctgttcggcac

SEQ ID NO: 10175 - DNA, 201 bp, Homo sapiens
cggcttctacggaagcagccgggaggccttcacctacgagcgccggccccagtcccaggcctacatccccaaggacgagggcgatttctactacctggggrggttcttcggggggtcggtgcaagaggtgcagcggctcaccagggcctgccaccaggccatgatggtcgaccaggccaacggcatcgaggccgtgtggca

SEQ ID NO: 10176 - DNA, 201 bp, Homo sapiens
caaggacgagggcgatttctactacctgggggggttcttcggggggtcggtgcaagaggtgcagcggctcaccagggcctgccaccaggccatgatggtcraccaggccaacggcatcgaggccgtgtggcacgacgagagccacctgaacaagtacctgctgcgccacaaacccaccaaggtgctctcccccgagtactt

SEQ ID NO: 10177 - DNA, 201 bp, Homo sapiens
tctcccccgagtacttgtgggaccagcagctgctgggctggcccgccgtcctgaggaagctgaggttcactgcggtgcccaagaaccaccaggcggtcccrgaacccgtgagcggctgccaggggctctgggagggctgccggcagccccgtccccctcccgcccttggttttagcagaacgggtaaactctgtttccttt

SEQ ID NO: 10178 - DNA, 201 bp, Homo sapiens
gctctcccccgagtacttgtgggaccagcagctgctgggctggcccgccgtcctgaggaagctgaggttcactgcggtgcccaagaaccaccaggcggtcbcggaacccgtgagcggctgccaggggctctgggagggctgccggcagccccgtccccctcccgcccttggttttagcagaacgggtaaactctgtttcct

SEQ ID NO: 10179 - DNA, 201 bp, Homo sapiens
cccgccgtcctgaggaagctgaggttcactgcggtgcccaagaaccaccaggcggtcccggaacccgtgagcggctgccaggggctctgggagggctgccrgcagccccgtccccctcccgcccttggttttagcagaacgggtaaactctgtttcctttgtccgtcctgttgtgagtaactgaagcctaggccccgtccc

SEQ ID NO: 10180 - DNA, 201 bp, Homo sapiens
gcaccccggcttctacggaagcagccgggaggccttcacctacgagcgccggccccagtcccaggcctacatccccaaggacgagggcgatttctactacmtgggggggttcttcggggggtcggtgcaagaggtgcagcggctcaccagggcctgccaccaggccatgatggtcgaccaggccaacggcatcgaggccgt

SEQ ID NO: 10181 - DNA, 201 bp, Homo sapiens
ccacaaacccaccaaggtgctctcccccgagtacttgtgggaccagcagctgctgggctggcccgccgtcctgaggaagctgaggttcactgcggtgcccragaaccaccaggcggtcccggaacccgtgagcggctgccaggggctctgggagggctgccggcagccccgtccccctcccgcccttggttttagcagaac

SEQ ID NO: 10182 - DNA, 201 bp, Homo sapiens
ggcttctacggaagcagccgggaggccttcacctacgagcgccggccccagtcccaggcctacatccccaaggacgagggcgatttctactacctgggggsgttcttcggggggtcggtgcaagaggtgcagcggctcaccagggcctgccaccaggccatgatggtcgaccaggccaacggcatcgaggccgtgtggcac

SEQ ID NO: 10183 - DNA, 201 bp, Homo sapiens
tcctgactccgctgttcggcaccctgcaccccggcttctacggaagcagccgggaggccttcacctacgagcgccggccccagtcccaggcctacatcccyaaggacgagggcgatttctactacctgggggggttcttcggggggtcggtgcaagaggtgcagcggctcaccagggcctgccaccaggccatgatggtcg

SEQ ID NO: 10184 - DNA, 201 bp, Homo sapiens
gagccacctgaacaagtacctgctgcgccacaaacccaccaaggtgctctcccccgagtacttgtgggaccagcagctgctgggctggcccgccgtcctgrggaagctgaggttcactgcggtgcccaagaaccaccaggcggtcccggaacccgtgagcggctgccaggggctctgggagggctgccggcagccccgtcc

SEQ ID NO: 10185 - DNA, 201 bp, Homo sapiens
cttcacctacgagcgccggccccagtcccaggcctacatccccaaggacgagggcgatttctactacctgggggggttcttcggggggtcggtgcaagagrtgcagcggctcaccagggcctgccaccaggccatgatggtcgaccaggccaacggcatcgaggccgtgtggcacgacgagagccacctgaacaagtacct

SEQ ID NO: 10186 - DNA, 201 bp, Homo sapiens
tgtggcacgacgagagccacctgaacaagtacctgctgcgccacaaacccaccaaggtgctctcccccgagtacttgtgggaccagcagctgctgggctgrcccgccgtcctgaggaagctgaggttcactgcggtgcccaagaaccaccaggcggtcccggaacccgtgagcggctgccaggggctctgggagggctgcc

SEQ ID NO: 10187 - DNA, 201 bp, Homo sapiens
cagcgaggtggattacctggtgtgcgtggacgtggacatggagttccgcgaccacgtgggcgtggagatcctgactccgctgttcggcaccctgcaccccrgcttctacggaagcagccgggaggccttcacctacgagcgccggccccagtcccaggcctacatccccaaggacgagggcgatttctactacctgggggg

SEQ ID NO: 10188 - DNA, 201 bp, Homo sapiens
cgaggtgttgcggacgctggccggaaaaccaaaatgccacgcacttcgacctatgatccttttcctaataatgcttgtcttggtcttgtttggttacgggktcctaagccccagaagtctaatgccaggaagcctggaacgggggttctgcatggctgttagggaacctgaccatctgcagcgcgtctcgttgccaaggat

SEQ ID NO: 10189 - DNA, 201 bp, Homo sapiens
ggccgaggtgttgcggacgctggccggaaaaccaaaatgccacgcacttcgacctatgatccttttcctaataatgcttgtcttggtcttgtttggttacrgggtcctaagccccagaagtctaatgccaggaagcctggaacgggggttctgcatggctgttagggaacctgaccatctgcagcgcgtctcgttgccaag

SEQ ID NO: 10190 - DNA, 201 bp, Homo sapiens
atggtcgaccaggccaacggcatcgaggccgtgtggcacgacgagagccacctgaacaagtacctgctgcgccacaaacccaccaaggtgctctcccccgrgtacttgtgggaccagcagctgctgggctggcccgccgtcctgaggaagctgaggttcactgcggtgcccaagaaccaccaggcggtcccggaacccgtg

SEQ ID NO: 10191 - DNA, 201 bp, Homo sapiens
ccccagtcccaggcctacatccccaaggacgagggcgatttctactacctgggggggttcttcggggggtcggtgcaagaggtgcagcggctcaccagggyctgccaccaggccatgatggtcgaccaggccaacggcatcgaggccgtgtggcacgacgagagccacctgaacaagtacctgctgcgccacaaacccacc

SEQ ID NO: 10192 - DNA, 201 bp, Homo sapiens
aggacgagggcgatttctactacctgggggggttcttcggggggtcggtgcaagaggtgcagcggctcaccagggcctgccaccaggccatgatggtcgascaggccaacggcatcgaggccgtgtggcacgacgagagccacctgaacaagtacctgctgcgccacaaacccaccaaggtgctctcccccgagtacttgt

SEQ ID NO: 10193 - DNA, 201 bp, Homo sapiens
atcaagaaatacgtggctttcctgaagctgttcctggagacggcggagaagcacttcatggtgggccaccgtgtccactactatgtcttcaccgaccagcyggccgcggtgccccgcgtgacgctggggaccggtcggcagctgtcagtgctggaggtgcgcgcctacaagcgctggcaggacgtgtccatgcgccgcatg

SEQ ID NO: 10194 - DNA, 158 bp, Homo sapiens
agacgcggagccatggccgaggtgttgcggacgctggccggaaaaccaaaatgccacrcacttcgacctatgatccttttcctaataatgcttgtcttggtcttgtttggttacggggtcctaagccccagaagtctaatgccaggaagcctggaacg

SEQ ID NO: 10195 - DNA, 201 bp, Homo sapiens
gaccggtcggcagctgtcagtgctggaggtgcgcgcctacaagcgctggcaggacgtgtccatgcgccgcatggagatgatcagtgacttctgcgagcggygcttcctcagcgaggtggattacctggtgtgcgtggacgtggacatggagttccgcgaccacgtgggcgtggagatcctgactccgctgttcggcaccct

SEQ ID NO: 10196 - DNA, 201 bp, Homo sapiens
tatgtcttcaccgaccagccggccgcggtgccccgcgtgacgctggggaccggtcggcagctgtcagtgctggaggtgcgcgcctacaagcgctggcaggrcgtgtccatgcgccgcatggagatgatcagtgacttctgcgagcggcgcttcctcagcgaggtggattacctggtgtgcgtggacgtggacatggagttc

SEQ ID NO: 10197 - DNA, 201 bp, Homo sapiens; identical to SEQ ID NO: 10146

SEQ ID NO: 10198 - DNA, 201 bp, Homo sapiens; identical to SEQ ID NO: 10147

SEQ ID NO: 10199 - DNA, 201 bp, Homo sapiens; identical to SEQ ID NO: 10148

SEQ ID NO: 10200 - DNA, 201 bp, Homo sapiens; identical to SEQ ID NO: 10149

SEQ ID NO: 10201 - DNA, 201 bp, Homo sapiens; identical to SEQ ID NO: 10150

SEQ ID NO: 10202 - DNA, 201 bp, Homo sapiens; identical to SEQ ID NO: 10151

SEQ ID NO: 10203 - DNA, 201 bp, Homo sapiens; identical to SEQ ID NO: 10152

SEQ ID NO: 10204 - DNA, 201 bp, Homo sapiens; identical to SEQ ID NO: 10153

SEQ ID NO: 10205 - DNA, 201 bp, Homo sapiens; identical to SEQ ID NO: 10154

SEQ ID NO: 10206 - DNA, 201 bp, Homo sapiens; identical to SEQ ID NO: 10155

SEQ ID NO: 10207 - DNA, 201 bp, Homo sapiens; identical to SEQ ID NO: 10156

SEQ ID NO: 10208 - DNA, 201 bp, Homo sapiens; identical to SEQ ID NO: 10157

SEQ ID NO: 10209 - DNA, 201 bp, Homo sapiens; identical to SEQ ID NO: 10158

SEQ ID NO: 10210 - DNA, 201 bp, Homo sapiens; identical to SEQ ID NO: 10159

SEQ ID NO: 10211 - DNA, 201 bp, Homo sapiens; identical to SEQ ID NO: 10160

SEQ ID NO: 10212 - DNA, 201 bp, Homo sapiens; identical to SEQ ID NO: 10161

SEQ ID NO: 10213 - DNA, 201 bp, Homo sapiens; identical to SEQ ID NO: 10162

SEQ ID NO: 10214 - DNA, 201 bp, Homo sapiens; identical to SEQ ID NO: 10163

SEQ ID NO: 10215 - DNA, 201 bp, Homo sapiens; identical to SEQ ID NO: 10164

SEQ ID NO: 10216 - DNA, 201 bp, Homo sapiens; identical to SEQ ID NO: 10165

SEQ ID NO: 10217 - DNA, 201 bp, Homo sapiens; identical to SEQ ID NO: 10166

SEQ ID NO: 10218 - DNA, 201 bp, Homo sapiens; identical to SEQ ID NO: 10167

SEQ ID NO: 10219 - DNA, 201 bp, Homo sapiens; identical to SEQ ID NO: 10168

SEQ ID NO: 10220 - DNA, 157 bp, Homo sapiens; identical to SEQ ID NO: 10169

SEQ ID NO: 10221 - DNA, 201 bp, Homo sapiens; identical to SEQ ID NO: 10170

SEQ ID NO: 10222 - DNA, 201 bp, Homo sapiens; identical to SEQ ID NO: 10171

SEQ ID NO: 10223 - DNA, 201 bp, Homo sapiens; identical to SEQ ID NO: 10172

SEQ ID NO: 10224 - DNA, 201 bp, Homo sapiens; identical to SEQ ID NO: 10173

SEQ ID NO: 10225 - DNA, 201 bp, Homo sapiens; identical to SEQ ID NO: 10174

SEQ ID NO: 10226 - DNA, 201 bp, Homo sapiens; identical to SEQ ID NO: 10175

SEQ ID NO: 10227 - DNA, 201 bp, Homo sapiens; identical to SEQ ID NO: 10176

SEQ ID NO: 10228 - DNA, 201 bp, Homo sapiens; identical to SEQ ID NO: 10177

SEQ ID NO: 10229 - DNA, 201 bp, Homo sapiens; identical to SEQ ID NO: 10178

SEQ ID NO: 10230 - DNA, 201 bp, Homo sapiens; identical to SEQ ID NO: 10179

SEQ ID NO: 10231 - DNA, 201 bp, Homo sapiens; identical to SEQ ID NO: 10180

SEQ ID NO: 10232 - DNA, 201 bp, Homo sapiens; identical to SEQ ID NO: 10181

SEQ ID NO: 10233 - DNA, 201 bp, Homo sapiens; identical to SEQ ID NO: 10182

SEQ ID NO: 10234 - DNA, 201 bp, Homo sapiens; identical to SEQ ID NO: 10183

SEQ ID NO: 10235 - DNA, 201 bp, Homo sapiens; identical to SEQ ID NO: 10184

SEQ ID NO: 10236 - DNA, 201 bp, Homo sapiens; identical to SEQ ID NO: 10185

SEQ ID NO: 10237 - DNA, 201 bp, Homo sapiens; identical to SEQ ID NO: 10186

SEQ ID NO: 10238 - DNA, 201 bp, Homo sapiens; identical to SEQ ID NO: 10187

SEQ ID NO: 10239 - DNA, 201 bp, Homo sapiens; identical to SEQ ID NO: 10188

SEQ ID NO: 10240 - DNA, 201 bp, Homo sapiens; identical to SEQ ID NO: 10189

SEQ ID NO: 10241 - DNA, 201 bp, Homo sapiens; identical to SEQ ID NO: 10190

SEQ ID NO: 10242 - DNA, 201 bp, Homo sapiens; identical to SEQ ID NO: 10191

SEQ ID NO: 10243 - DNA, 201 bp, Homo sapiens; identical to SEQ ID NO: 10192

SEQ ID NO: 10244 - DNA, 201 bp, Homo sapiens; identical to SEQ ID NO: 10193

SEQ ID NO: 10245 - DNA, 158 bp, Homo sapiens; identical to SEQ ID NO: 10194

SEQ ID NO: 10246 - DNA, 201 bp, Homo sapiens; identical to SEQ ID NO: 10195

SEQ ID NO: 10247 - DNA, 201 bp, Homo sapiens; identical to SEQ ID NO: 10196

SEQ ID NO: 10248 - DNA, 201 bp, Homo sapiens
gagccagtccagtgacacaggatgaccttcagtatcacaacctcagcaagcagcagaatgagtccccgcagcccctcgtggagacgggaaagaagtctccrgaatctctggtcaagctggatgcaaccccattgtcctccccacggcatgtgaggatcaaaaactggggcagcgggatgactttccaagacacacttcacc

SEQ ID NO: 10249 - DNA, 201 bp, Homo sapiens
gctccccatcaagccctttacttgacctcctaacaagtagcaccctggattgatcggagcctcctctctcaaactggggcctccctggtcccttggagacraaatcttaaatgccaggcctggcaagtgggtgaaagatggaacttgctgctgagtgcaccacttcaagtgaccaccaggaggtgctatcgcaccactgtg

SEQ ID NO: 10250 - DNA, 201 bp, Homo sapiens
tcagctcaccccgatgggagaaggggatgagctcagtgggcaggaggacgccttccgcagctgggccgtgcaaaccttcaaggcagcctgtgagacgtttsatgtccgaggcaaacagcacattcagatccccaagctctacacctccaatgtgacctgggacccgcaccactacaggctcgtgcaggactcacagccttt

SEQ ID NO: 10251 - DNA, 201 bp, Homo sapiens
ccatagagatggcctgtccttggaaatttctgttcaagaccaaattccaccagtatgcaatgaatggggaaaaagacatcaacaacaatgtggagaaagcyccctgtgccacctccagtccagtgacacaggatgaccttcagtatcacaacctcagcaagcagcagaatgagtccccgcagcccctcgtggagacgggaa

SEQ ID NO: 10252 - DNA, 201 bp, Homo sapiens
acccccgtgtttcaccaggagatgctgaactacgtcctgtcccctttctactactatcaggtagaggcctggaaaacccatgtctggcaggacgagaagcrgagacccaagagaagagagattccattgaaagtcttggtcaaagctgtgctctttgcctgtatgctgatgcgcaagacaatggcgtcccgagtcagagtc

SEQ ID NO: 10253 - DNA, 201 bp, Homo sapiens
tcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggcagctactgggtcagtgacaagaggctgc

SEQ ID NO: 10254 - DNA, 201 bp, Homo sapiens
cctccagtccagtgacacaggatgaccttcagtatcacaacctcagcaagcagcagaatgagtccccgcagcccctcgtggagacgggaaagaagtctccrgaatctctggtcaagctggatgcaaccccattgtcctccccacggcatgtgaggatcaaaaactggggcagcgggatgactttccaagacacacttcacc

SEQ ID NO: 10255 - DNA, 201 bp, Homo sapiens
tgcccccctgctcactcagccaggccctcacctacttcctggacatcaccacacccccacccagctgctgctccaaaagctggcccaggtggccacagaaragcctgagagacgaggctggaggccctgtgccagccctcagagtacagcaagtggaagttcaccaacagccccacattcctggaggtgctagaggagttc

SEQ ID NO: 10256 - DNA, 201 bp, Homo sapiens
aggtggccacagaaaagcctgagagacgaggctggaggccctgtgccagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccggga

SEQ ID NO: 10257 - DNA, 201 bp, Homo sapiens
ttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaaatacgagtggtttcgggaactggagctaaagtggtacgccctgcctgcagtgg

SEQ ID NO: 10258 - DNA, 201 bp, Homo sapiens
tggccaacatgctgcttgaggtgggcggcctggagttcccagggtgccccttcaatggctggtacatgggcacagagatcggagtccgggacttctgtgaygtccagcgctacaacatcctggaggaagtgggcaggagaatgggcctggaaacgcacaagctggcctcgctctggaaagaccaggctgtcgttgagatca

SEQ ID NO: 10259 - DNA, 201 bp, Homo sapiens
gccagaagcgctatcacgaagatatctttggtgctgtatttccttacgaggcgaagaaggacagggtggcggtgcagcccagcagcctggagatgtcagcrctctgagggcctacaggaggggttaaagctgccggcacagaacttaaggatggagccagctctgcattatctgaggtcacagggcctggggagatggagg

SEQ ID NO: 10260 - DNA, 201 bp, Homo sapiens
cttcgccaccaagcaggcctggcgcaatgccccacgctgcattgggaggatccagtggtccaacctgcaggtcttcgatgcccgcagctgttccactgccygggaaatgtttgaacacatctgcagacacgtgcgttactccaccaacaatggcaacatcaggtcggccatcaccgtgttcccccagcggagtgatggcaa

SEQ ID NO: 10261 - DNA, 201 bp, Homo sapiens
tcccgtccctgcgggtgtctgctggcttcctgctttcccagctccccattctgaagcccaggttctactccatcagctcctcccgggatcacacgcccacrgagatccacctgactgtggccgtggtcacctaccacacccgagatggccagggtcccctgcaccacggcgtctgcagcacatggctcaacagcctgaagc

SEQ ID NO: 10262 - DNA, 201 bp, Homo sapiens
accacacccgagatggccagggtcccctgcaccacggcgtctgcagcacatggctcaacagcctgaagccccaagacccagtgccctgctttgtgcggaaygccagcggcttccacctccccgaggatccctcccatccttgcatcctcatcgggcctggcacaggcatcgcgcccttccgcagtttctggcagcaacggc

SEQ ID NO: 10263 - DNA, 201 bp, Homo sapiens
tgaaattgaatgaggagcaggtcgaggactatttctttcagctcaagagccagaagcgctatcacgaagatatctttggtgctgtatttccttacgaggcraagaaggacagggtggcggtgcagcccagcagcctggagatgtcagcgctctgagggcctacaggaggggttaaagctgccggcacagaacttaaggatg

SEQ ID NO: 10264 - DNA, 201 bp, Homo sapiens
tacaggctgagctgcctggaggaggaacggctgctgttggtggtgaccagtacgtttggcaatggagactgccctggcaatggagagaaactgaagaaatygctcttcatgctgaaagagctcaacaacaaattcaggtacgctgtgtttggcctcggctccagcatgtaccctcggttctgcgcctttgctcatgacatt

SEQ ID NO: 10265 - DNA, 201 bp, Homo sapiens
ctgcagcacatggctcaacagcctgaagccccaagacccagtgccctgctttgtgcggaatgccagcggcttccacctccccgaggatccctcccatcctygcatcctcatcgggcctggcacaggcatcgcgcccttccgcagtttctggcagcaacggctccatgactcccagcacaagggagtgcggggaggccgcat

SEQ ID NO: 10266 - DNA, 201 bp, Homo sapiens
tgcagcccagcagcctggagatgtcagcgctctgagggcctacaggaggggttaaagctgccggcacagaacttaaggatggagccagctctgcattatcygaggtcacagggcctggggagatggaggaaagtgatatcccccagcctcaagtcttatttcctcaacgttgctccccatcaagccctttacttgacctcc

SEQ ID NO: 10267 - DNA, 201 bp, Homo sapiens
taaagctgccggcacagaacttaaggatggagccagctctgcattatctgaggtcacagggcctggggagatggaggaaagtgatatcccccagcctcaaktcttatttcctcaacgttgctccccatcaagccctttacttgacctcctaacaagtagcaccctggattgatcggagcctcctctctcaaactggggcct

SEQ ID NO: 10268 - DNA, 201 bp, Homo sapiens; identical to SEQ ID NO: 10249

SEQ ID NO: 10269 - DNA, 201 bp, Homo sapiens; identical to SEQ ID NO: 10250

SEQ ID NO: 10270 - DNA, 201 bp, Homo sapiens; identical to SEQ ID NO: 10251

SEQ ID NO: 10271 - DNA, 201 bp, Homo sapiens; identical to SEQ ID NO: 10252

SEQ ID NO: 10272 - DNA, 201 bp, Homo sapiens; identical to SEQ ID NO: 10253

SEQ ID NO: 10273 - DNA, 201 bp, Homo sapiens; identical to SEQ ID NO: 10254

SEQ ID NO: 10274 - DNA, 201 bp, Homo sapiens; identical to SEQ ID NO: 10255

SEQ ID NO: 10275 - DNA, 201 bp, Homo sapiens; identical to SEQ ID NO: 10256

SEQ ID NO: 10276 - DNA, 201 bp, Homo sapiens
tcactcagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaaatacgagtggtttcgggaactggagctaaagtggtacgccctgcctgcagtgg

SEQ ID NO: 10277 - DNA, 201 bp, Homo sapiens; identical to SEQ ID NO: 10258

SEQ ID NO: 10278 - DNA, 201 bp, Homo sapiens; identical to SEQ ID NO: 10259

SEQ ID NO: 10279 - DNA, 201 bp, Homo sapiens; identical to SEQ ID NO: 10260

SEQ ID NO: 10280 - DNA, 201 bp, Homo sapiens; identical to SEQ ID NO: 10261

SEQ ID NO: 10281 - DNA, 201 bp, Homo sapiens; identical to SEQ ID NO: 10262

SEQ ID NO: 10282 - DNA, 201 bp, Homo sapiens; identical to SEQ ID NO: 10263

SEQ ID NO: 10283 - DNA, 201 bp, Homo sapiens; identical to SEQ ID NO: 10264

SEQ ID NO: 10284 - DNA, 201 bp, Homo sapiens; identical to SEQ ID NO: 10265

SEQ ID NO: 10285 - DNA, 201 bp, Homo sapiens; identical to SEQ ID NO: 10266

SEQ ID NO: 10286 - DNA, 201 bp, Homo sapiens; identical to SEQ ID NO: 10267

SEQ ID NO: 10287 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttgtcctgccagcgactcccccacaacttgtcagcccccgggtcc

SEQ ID NO: 10288 - DNA, 201 bp, Homo sapiens
agaacacctcggccccctaccagctccagacctttgtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 10289 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttgtcctgccagcgactcccccacaacttgtcagcccccgggtcct

SEQ ID NO: 10290 - DNA, 154 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcc

SEQ ID NO: 10291 - DNA, 201 bp, Homo sapiens
ccagctccagacctttgtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 10292 - DNA, 154 bp, Homo sapiens
gcgccccagtcgacgctgagctcctctgctactcagagttgcaacctcagcctmgctatggctcccagcagcccccggcccgcgctgcccgcactcctggtcctgctcggggctctgttcccaggacctggcaatgcccagacatctgtgtccc

SEQ ID NO: 10293 - DNA, 201 bp, Homo sapiens
aagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaac

SEQ ID NO: 10294 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctccccccggtatgagattgtcatcatcactgtggtagcagccgcagtcataatgggcactgcaggcctcagcacgtacct

SEQ ID NO: 10295 - DNA, 201 bp, Homo sapiens
tatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaaatggggctgggacttctcattggccaac

SEQ ID NO: 10296 - DNA, 168 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcc

SEQ ID NO: 10297 - DNA, 201 bp, Homo sapiens
gacaacgggcgcagcttctcctgctctgcaaccctggaggtggccggccagcttatacacaagaaccagacccgggagcttcgtgtcctgtatggcccccractggacgagagggattgtccgggaaactggacgtggccagaaaattcccagcagactccaatgtgccaggcttgggggaacccattgcccgagctcaag

SEQ ID NO: 10298 - DNA, 201 bp, Homo sapiens
ggacgagggcacccagcggctgacgtgtgcagtaatactggggaaccagagccaggagacactgcagacagtgaccatctacagctttccggcgcccaacrtgattctgacgaagccagaggtctcagaagggaccgaggtgacagtgaagtgtgaggcccaccctagagccaaggtgacgctgaatggggttccagccca

SEQ ID NO: 10299 - DNA, 114 bp, Homo sapiens
gcgccccagtcgaygctgagctcctctgctactcagagttgcaacctcagcctcgctatggctcccagcagcccccggcccgcgctgcccgcactcctggtcctgctcggggct

SEQ ID NO: 10300 - DNA, 201 bp, Homo sapiens
taaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctaccggccctgg

SEQ ID NO: 10301 - DNA, 201 bp, Homo sapiens
tgcagctccagtttcctgcagtgatcagggtcctgcaagcagtggggaagggggccaaggtattggaggactccctcccagctttggaagcctcatccgcktgtgtgtgtgtgtgtatgtgtagacaagctctcgctctgtcacccaggctggagtgcagtggtgcaatcatggttcactgcagtcttgaccttttgggct

SEQ ID NO: 10302 - DNA, 201 bp, Homo sapiens
agctccagacctttgtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 10303 - DNA, 201 bp, Homo sapiens
cctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactg

SEQ ID NO: 10304 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtatggcccccgactggacgagagggattgtccgggaaactggacgtggccagaaaattcccagcagactccaatgt

SEQ ID NO: 10305 - DNA, 201 bp, Homo sapiens
caggttgtacactgcaggagagtgcctggcaaaaagatcaaatggggctgggacttctcattggccaacctgcctttccccagaaggagtgatttttctaycggcacaaaagcactatatggactggtaatggttacaggttcagagattacccagtgaggccttattcctcccttccccccaaaactgacacctttgtta

SEQ ID NO: 10306 - DNA, 201 bp, Homo sapiens
cgcgtgtgtgtgtgtgtgtatgtgtagacaagctctcgctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgatttttttttttttttcagagacg

SEQ ID NO: 10307 - DNA, 201 bp, Homo sapiens
gtgaggcccaccctagagccaaggtgacgctgaatggggttccagcccagccactgggcccgagggcccagctcctgctgaaggccaccccagaggacaaygggcgcagcttctcctgctctgcaaccctggaggtggccggccagcttatacacaagaaccagacccgggagcttcgtgtcctgtatggcccccgactgg

SEQ ID NO: 10308 - DNA, 201 bp, Homo sapiens
tctctggcctcacggagctcccagtcctaatcacattcaaggtcaccaggtacagttgtacaggttgtacactgcaggagagtgcctggcaaaaagatcaratggggctgggacttctcattggccaacctgcctttccccagaaggagtgatttttctatcggcacaaaagcactatatggactggtaatggttacaggt

SEQ ID NO: 10309 - DNA, 169 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcc

SEQ ID NO: 10310 - DNA, 162 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcc

SEQ ID NO: 10311 - DNA, 201 bp, Homo sapiens
cctatcccgggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctg

SEQ ID NO: 10312 - DNA, 149 bp, Homo sapiens
gcgccccagtcgacgctgagctcctctgctactcagagttgcaacctcmgcctcgctatggctcccagcagcccccggcccgcgctgcccgcactcctggtcctgctcggggctctgttcccaggacctggcaatgcccagacatctgt

SEQ ID NO: 10313 - DNA, 201 bp, Homo sapiens
actccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcaaggtgaccgtgaatgtgctctccccccggtatgagattgtc

SEQ ID NO: 10314 - DNA, 201 bp, Homo sapiens
gcaagcagtggggaagggggccaaggtattggaggactccctcccagctttggaagcctcatccgcgtgtgtgtgtgtgtgtatgtgtagacaagctctckctctgtcacccaggctggagtgcagtggtgcaatcatggttcactgcagtcttgaccttttgggctcaagtgatcctcccacctcagcctcctgagtagc

SEQ ID NO: 10315 - DNA, 201 bp, Homo sapiens
ggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaa

SEQ ID NO: 10316 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagctttccggcgcccaacgtga

SEQ ID NO: 10317 - DNA, 201 bp, Homo sapiens
tagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtc

SEQ ID NO: 10318 - DNA, 154 bp, Homo sapiens; identical to SEQ ID NO: 10290

SEQ ID NO: 10319 - DNA, 201 bp, Homo sapiens
cactttcccactgcccatcggggaatcagtgactgtcactcgagatcttgagggcacctacctctgtcgggccaggagcactcaaggggaggtcacccgcragccccccggtatgagattgtcatcatcactgtggtagcagccgcagtcataatgggcactgcaggcctcagcacgtacctctataaccgccagcggaag

SEQ ID NO: 10320 - DNA, 201 bp, Homo sapiens; identical to SEQ ID NO: 10295

SEQ ID NO: 10321 - DNA, 168 bp, Homo sapiens; identical to SEQ ID NO: 10296

SEQ ID NO: 10322 - DNA, 123 bp, Homo sapiens
cgtgtttttccagatggcccccractggacgagagggattgtccgggaaactggacgtggccagaaaattcccagcagactccaatgtgccaggcttgggggaacccattgcccgagctcaag

SEQ ID NO: 10323 - DNA, 102 bp, Homo sapiens
crtgtttttccagatggcccccgactggacgagagggattgtccgggaaactggacgtggccagaaaattcccagcagactccaatgtgccaggcttggggg

SEQ ID NO: 10324 - DNA, 201 bp, Homo sapiens; identical to SEQ ID NO: 10300

SEQ ID NO: 10325 - DNA, 201 bp, Homo sapiens; identical to SEQ ID NO: 10301

SEQ ID NO: 10326 - DNA, 201 bp, Homo sapiens; identical to SEQ ID NO: 10305

SEQ ID NO: 10327 - DNA, 201 bp, Homo sapiens; identical to SEQ ID NO: 10306

SEQ ID NO: 10328 - DNA, 162 bp, Homo sapiens; identical to SEQ ID NO: 10310

SEQ ID NO: 10329 - DNA, 201 bp, Homo sapiens; identical to SEQ ID NO: 10308

SEQ ID NO: 10330 - DNA, 169 bp, Homo sapiens; identical to SEQ ID NO: 10309

SEQ ID NO: 10331 - DNA, 201 bp, Homo sapiens
actccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcaagccccccggtatgagattgtcatcatcactgtggtagcag

SEQ ID NO: 10332 - DNA, 201 bp, Homo sapiens; identical to SEQ ID NO: 10311

SEQ ID NO: 10333 - DNA, 201 bp, Homo sapiens; identical to SEQ ID NO: 10314

SEQ ID NO: 10334 - DNA, 201 bp, Homo sapiens; identical to SEQ ID NO: 10317

SEQ ID NO: 10335 - DNA, 201 bp, Homo sapiens
gcagatgaggttcctgcctactgtgtgccaccccaagaagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 10336 - DNA, 201 bp, Homo sapiens
gcgcacctccagcctagctcgggccaagcggccatcggtctccttcgcggaaggtaccaagtttgcaccacagagtcgccgaagctcaggggagctctccmgcccgctccgaaagcccaagaggctctcccggggggcgcagtcgggtcctgagggccgggaagccgaagagtccacaggcccagacgaagcagaagcccc

SEQ ID NO: 10337 - DNA, 201 bp, Homo sapiens
gccaagcggccatcggtctccttcgcggaaggtaccaagtttgcaccacagagtcgccgaagctcaggggagctctccagcccgctccgaaagcccaagargctctcccggggggcgcagtcgggtcctgagggccgggaagccgaagagtccacaggcccagacgaagcagaagcccccgagtcctttccggcggctgcc

SEQ ID NO: 10338 - DNA, 201 bp, Homo sapiens
gggccgggaagccgaagagtccacaggcccagacgaagcagaagcccccgagtcctttccggcggctgccagtcccggggattcagccactggccaccggyggcccccacttggtagccggacagtggctgagcacgtggaagccattgagggcagcgtccaggagagctcgggccctgtgaccacgatctacatgctggc

SEQ ID NO: 10339 - DNA, 201 bp, Homo sapiens
ttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggg

SEQ ID NO: 10340 - DNA, 201 bp, Homo sapiens
agagtccacaggcccagacgaagcagaagcccccgagtcctttccggcggctgccagtcccggggattcagccactggccaccggcggcccccacttggtrgccggacagtggctgagcacgtggaagccattgagggcagcgtccaggagagctcgggccctgtgaccacgatctacatgctggcagggaagccccgcgg

SEQ ID NO: 10341 - DNA, 201 bp, Homo sapiens
ccttcaaccacagcttcatcgagccgccctctgccggctgggccactgatgactccttctcatccgatcctgagtctggagaggcagatgaggttcctgcytactgtgtgccaccccaagaagggatggtccctgtggcccaggcagggtcgtcagaggccagcctggctgcaggtgctttcccgccccctgaggacgcct

SEQ ID NO: 10342 - DNA, 201 bp, Homo sapiens
gggctgggggctggcaccgagagttcaaggagagcccaggagccagtctctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagac

SEQ ID NO: 10343 - DNA, 201 bp, Homo sapiens
ggcttcctggggccacagggcctatggcagtcagaccagaggaagcggtccgggggctgggggctggcaccgagagttcaaggagagcccaggagccagtmtctggctgtggctccccagaacaggatccccagaagcaggctgaagaggaaaggcaggaggaacctgagtatgagaatgttgtacccatctccaggccac

SEQ ID NO: 10344 - DNA, 201 bp, Homo sapiens
gtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgc

SEQ ID NO: 10345 - DNA, 201 bp, Homo sapiens
caatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccag

SEQ ID NO: 10346 - DNA, 201 bp, Homo sapiens
tgggctccacgctgccctgccgttccctcagctcccacaagctaccctgggtgacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 10347 - DNA, 201 bp, Homo sapiens
aacaactgctcagttccttgtgaatgcccagagggactctgccaccctgtctctgggtcctgccagccaggctctggcagtcgggacactgccctcatcgygggcagccttgtgcctctgctgctgctcttcctgggtcttgcctgctgtgcctgctgctgctgggccccccgatcagacctcaaggacaggccagcgaga

SEQ ID NO: 10348 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaagggatggtccctgtggcccaggcagggtcgtcagaggccagcctggctgcaggtgctttcccgccccctgaggacgc

SEQ ID NO: 10349 - DNA, 201 bp, Homo sapiens
caggggagctctccagcccgctccgaaagcccaagaggctctcccggggggcgcagtcgggtcctgagggccgggaagccgaagagtccacaggcccagasgaagcagaagcccccgagtcctttccggcggctgccagtcccggggattcagccactggccaccggcggcccccacttggtagccggacagtggctgagc

SEQ ID NO: 10350 - DNA, 201 bp, Homo sapiens
cgcggaaggtaccaagtttgcaccacagagtcgccgaagctcaggggagctctccagcccgctccgaaagcccaagaggctctcccggggggcgcagtcgrgtcctgagggccgggaagccgaagagtccacaggcccagacgaagcagaagcccccgagtcctttccggcggctgccagtcccggggattcagccactgg

SEQ ID NO: 10351 - DNA, 201 bp, Homo sapiens
tctgccaccctgtctctgggtcctgccagccaggctctggcagtcgggacactgccctcatcgtgggcagccttgtgcctctgctgctgctcttcctgggycttgcctgctgtgcctgctgctgctgggccccccgatcagacctcaaggacaggccagcgagagatggagctaccgtgtccaggatgaagctgcaggtct

SEQ ID NO: 10352 - DNA, 201 bp, Homo sapiens
ctgcaggtgctttcccgccccctgaggacgcctccacgccattcgccatcccgcgcacctccagcctagctcgggccaagcggccatcggtctccttcgcrgaaggtaccaagtttgcaccacagagtcgccgaagctcaggggagctctccagcccgctccgaaagcccaagaggctctcccggggggcgcagtcgggtc

SEQ ID NO: 10353 - DNA, 201 bp, Homo sapiens
tgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacg

SEQ ID NO: 10354 - DNA, 201 bp, Homo sapiens
atcttgtaaaggtcctggcaaagatgatcagtatgaaaatgtcattgttcttgtgaacccaaagtgtgactcattaaatggaagtaaatgttgttttaggratacataaagtatgtgcatattttattatagtcactagttgtaatttttttgtgggaaatccacactgagctgagggggacaaagatggctgtggccaag

SEQ ID NO: 10355 - DNA, 201 bp, Homo sapiens
gtgttgcctaatttgttttcccttcttacaatgcattctgaggtaacctcattatcagtccaaagggcatgggttttattatatatatatatttttttttwtaaaaaaaaacgtattgcatttaatttattgaggctttaaaacttatcctccatgaatatcagttatttttaaactgtaaagctttgtgcagattcttta

SEQ ID NO: 10356 - DNA, 201 bp, Homo sapiens
accagtggcaaatgtccccagaaagctgtgatcttcaagaccaaactggccaaggatatctgtgccgaccccaagaagaagtgggtgcaggattccatgamgtatctggaccaaaaatctccaactccaaagccataaataatcaccatttttgaaaccaaaccagagcctgagtgttgcctaatttgttttcccttctta

SEQ ID NO: 10357 - DNA, 201 bp, Homo sapiens
gtccccagaaagctgtgatcttcaagaccaaactggccaaggatatctgtgccgaccccaagaagaagtgggtgcaggattccatgaagtatctggaccaraaatctccaactccaaagccataaataatcaccatttttgaaaccaaaccagagcctgagtgttgcctaatttgttttcccttcttacaatgcattctga

SEQ ID NO: 10358 - DNA, 201 bp, Homo sapiens
tctcacgccaaagctcacaccttcagcctccaacatgaaggtctccgcagcacttctgtggctgctgctcatagcagctgccttcagcccccaggggctcrctgggccagcttctgtcccaaccacctgctgctttaacctggccaataggaagataccccttcagcgactagagagctacaggagaatcaccagtggcaa

SEQ ID NO: 10359 - DNA, 182 bp, Homo sapiens
atgggcaaaggcttccctggaatctcccacactgtctgctccctataaaaggcaggcagatgggccagaggagcagagaggytgagaccaacccagaaaccaccacctctcacgccaaagctcacaccttcagcctccaacatgaaggtctccgcagcacttctgtggctgctgctcatagc

SEQ ID NO: 10360 - DNA, 201 bp, Homo sapiens
tgttgcctaatttgttttcccttcttacaatgcattctgaggtaacctcattatcagtccaaagggcatgggttttattatatatatatattttttttttwaaaaaaaaacgtattgcatttaatttattgaggctttaaaacttatcctccatgaatatcagttatttttaaactgtaaagctttgtgcagattctttac

SEQ ID NO: 10361 - DNA, 201 bp, Homo sapiens
ttaactatcattgtaataatggaagacaaaaatccagccccgggagaacagcatgtacaccagcctcagtgttacagagtgtgggtacatcaaggtgaatrgtgagcagaaactataacctgttagtccttctacacctcatctgctacaagttctggcttagacatggatattctttgtgaagaaaatacttctttgagc

SEQ ID NO: 10362 - DNA, 201 bp, Homo sapiens
aattactgtgagagatgcagcgagtcacagaataacaaatgtatctcatgtgtgaaccctgaagacaaatgacatttatcttcccgaacgctcaaaaaaarccctgcaacctctatgctaaaagttcattctgcttttttgtcctcggtttggtgagaaaataataaaaccaaacagtggactctcctaaaattgtgaatg

SEQ ID NO: 10363 - DNA, 201 bp, Homo sapiens
tctacaccagtttaattactgtgagagatgcagcgagtcacagaataacaaatgtatctcatgtgtgaaccctgaagacaaatgacatttatcttcccgarcgctcaaaaaaaaccctgcaacctctatgctaaaagttcattctgcttttttgtcctcggtttggtgagaaaataataaaaccaaacagtggactctcct

SEQ ID NO: 10364 - DNA, 201 bp, Homo sapiens
aggtcagccttttcacggtatattcagtgtcagtacaaggaaaacaaaaaaccattgcagttaattttagtgaacacaataccggctttggcctacaagtytagccaacttcaaatgggacaaaaaaagaattcaaagcaagatgccaagacaacagataatgactgctcaatggttgctctaggaaagcagcattctgaa

SEQ ID NO: 10365 - DNA, 201 bp, Homo sapiens
tcatctgctacaagttctggcttagacatggatattctttgtgaagaaaatacttctttgagctcaactacgaactccctaatgcaattaaatgatgacamcaggctctacagtaatgactttaactctggagaagctaacacttctgatgcatttaactggacagtcgactctgaaaatcgaaccaacctttcctgtgaa

SEQ ID NO: 10366 - DNA, 201 bp, Homo sapiens
atgtgtgaaccctgaagacaaatgacatttatcttcccgaacgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgta

SEQ ID NO: 10367 - DNA, 201 bp, Homo sapiens
accggtggcctctgccgagcaagctttgtgcagtctggatttacctggacgtgctcttctccacggcctccatcatgcacctctgcgccatctcgctggaycgctacgtcgccatccagaatcccatccaccacagccgcttcaactccagaactaaggcatttctgaaaatcattgctgtttggaccatatcagtaggta

SEQ ID NO: 10368 - DNA, 201 bp, Homo sapiens
catgcacctctgcgccatctcgctggaccgctacgtcgccatccagaatcccatccaccacagccgcttcaactccagaactaaggcatttctgaaaatcrttgctgtttggaccatatcagtaggtatatccatgccaataccagtctttgggctacaggacgattcgaaggtctttaaggaggggagttgcttactcgc

SEQ ID NO: 10369 - DNA, 201 bp, Homo sapiens
tattatgctggtggaagatcaagaagaggggactctacaccagtttaattactgtgagagatgcagcgagtcacagaataacaaatgtatctcatgtgtgraccctgaagacaaatgacatttatcttcccgaacgctcaaaaaaaaccctgcaacctctatgctaaaagttcattctgcttttttgtcctcggtttggtg

SEQ ID NO: 10370 - DNA, 201 bp, Homo sapiens
ctacaagtctagccaacttcaaatgggacaaaaaaagaattcaaagcaagatgccaagacaacagataatgactgctcaatggttgctctaggaaagcagyattctgaagaggcttctaaagacaatagcgacggagtgaatgaaaaggtgagctgtgtgtgataggctagttgccgtggcaactgtggaaggcacactga

SEQ ID NO: 10371 - DNA, 201 bp, Homo sapiens
ctgtggaaggcacactgagcaagttttcacctatctggaaaaaaaaaaatatgagattggaaaaaattagacaagtctagtggaaccaacgatcatatctstatgcctcattttattctgtcaatgaaaagcggggttcaatgctacaaaatgtgtgcttggaaaatgttctgacagcatttcagctgtgagctttctgat

SEQ ID NO: 10372 - DNA, 201 bp, Homo sapiens
ataccggctttggcctacaagtctagccaacttcaaatgggacaaaaaaagaattcaaagcaagatgccaagacaacagataatgactgctcaatggttgytctaggaaagcagcattctgaagaggcttctaaagacaatagcgacggagtgaatgaaaaggtgagctgtgtgtgataggctagttgccgtggcaactgt

SEQ ID NO: 10373 - DNA, 201 bp, Homo sapiens
aaattaacttctattttcaagtggaaaccttgctgctatgctgttcattgatgacatgggattgagttggttacctattgctgtaaataaaaatagctatmaatagtgaaaattttattgaatataatggcctcttaaaaattatctttaaaacttactatggtatatattttgaaaggagaaaaaaaaagccactaaggt

SEQ ID NO: 10374 - DNA, 201 bp, Homo sapiens
tcaactccagaactaaggcatttctgaaaatcattgctgtttggaccatatcagtaggtatatccatgccaataccagtctttgggctacaggacgattcraaggtctttaaggaggggagttgcttactcgccgatgataactttgtcctgatcggctcttttgtgtcatttttcattcccttaaccatcatggtgatca

SEQ ID NO: 10375 - DNA, 201 bp, Homo sapiens
acacactgttcaacaagacctataggtcagccttttcacggtatattcagtgtcagtacaaggaaaacaaaaaaccattgcagttaattttagtgaacacwataccggctttggcctacaagtctagccaacttcaaatgggacaaaaaaagaattcaaagcaagatgccaagacaacagataatgactgctcaatggttg

SEQ ID NO: 10376 - DNA, 201 bp, Homo sapiens
acttgaggcttaacattgcaattaatttagaaatacgcacctcaatctcaagccagtttataactaccatagttttgagcaaaatttttcttctatttctycaaaaactcactcatttcagtattactcattgacactgggctccctaatagaaaagcagatattataatatttcattgaaatggttactaaagagaaaaa

SEQ ID NO: 10377 - DNA, 201 bp, Homo sapiens
agagtgagaccctatcacaaaaaaaaagaaagaaaaaaagaaaatgactaaactgaaatggtcttagtcaaaaaatatatacagacttatttttagaatcmtttcaacttatttccttcttacctggttcagaaacaagtttgtttcaactgtgagagtagttttaaaaataagttttcctgattggttaccaataaacac

SEQ ID NO: 10378 - DNA, 201 bp, Homo sapiens
atttatcttcccgaacgctcaaaaaaaaccctgcaacctctatgctaaaagttcattctgcttttttgtcctcggtttggtgagaaaataataaaaccaarcagtggactctcctaaaattgtgaatgaagaaaacttacagccaccacagttcagttctttaactatcattgtaataatggaagacaaaaatccagcccc

SEQ ID NO: 10379 - DNA, 201 bp, Homo sapiens
tggatattctttgtgaagaaaatacttctttgagctcaactacgaactccctaatgcaattaaatgatgacaccaggctctacagtaatgactttaactcyggagaagctaacacttctgatgcatttaactggacagtcgactctgaaaatcgaaccaacctttcctgtgaagggtgcctctcaccgtcgtgtctctcct

SEQ ID NO: 10380 - DNA, 201 bp, Homo sapiens
catgtgtgaaccctgaagacaaatgacatttatcttcccgaacgctcaaaaaaaaccctgcaacctctatgctaaaagttcattctgcttttttgtcctckgtttggtgagaaaataataaaaccaaacagtggactctcctaaaattgtgaatgaagaaaacttacagccaccacagttcagttctttaactatcattgt

SEQ ID NO: 10381 - DNA, 201 bp, Homo sapiens
gggactctacaccagtttaattactgtgagagatgcagcgagtcacagaataacaaatgtatctcatgtgtgaaccctgaagacaaatgacatttatcttyccgaacgctcaaaaaaaaccctgcaacctctatgctaaaagttcattctgcttttttgtcctcggtttggtgagaaaataataaaaccaaacagtggact

SEQ ID NO: 10382 - DNA, 201 bp, Homo sapiens
gcctcttccttacccatgctttggggtgttaacagctgaggctattcgtcggtgacctgtgggactcgagctattcctgcagctcagcagacctcctggcygtggcagacttctgcgttatgacccggctgctgggctacgtggaccccctggatcccagctttgtggctgccgtcatcaccatcaccttcaatccgctct

SEQ ID NO: 10383 - DNA, 201 bp, Homo sapiens
tgtgggactcgagctattcctgcagctcagcagacctcctggccgtggcagacttctgcgttatgacccggctgctgggctacgtggaccccctggatccyagctttgtggctgccgtcatcaccatcaccttcaatccgctctactggaatgtggttgcacgatgggaacacaagacccgcaagctgagcagggccttcg

SEQ ID NO: 10384 - DNA, 201 bp, Homo sapiens
tcctgaacttcctgcgctcgcactgcttcacgcaggccatgctgagccagcccaggatggagagcctggacacccccgcggcctacagcctgggcctcgcrctcctgggactgggcgtcgtgctcgtgctctccagcttctttgcactggggttcgctggaactttcctaggtgattacttcgggatcctcaaggaggcga

SEQ ID NO: 10385 - DNA, 201 bp, Homo sapiens
caatccgctctactggaatgtggttgcacgatgggaacacaagacccgcaagctgagcagggccttcggatccccctacctggcctgctactctctaagcvtcaccatcctgctcctgaacttcctgcgctcgcactgcttcacgcaggccatgctgagccagcccaggatggagagcctggacacccccgcggcctacag

SEQ ID NO: 10386 - DNA, 201 bp, Homo sapiens
catgtactggggaagcacagccaactacctgggctgggccatcatgcacgccagccccacgggcctgctcctgacggtgctggtggccctcacctacatartggctctcctatacgaagagcccttcaccgctgagatctaccggcagaaagcctccgggtcccacaagaggagctgattgagctgcaacagctttgctga

SEQ ID NO: 10387 - DNA, 201 bp, Homo sapiens
tataggtccggttccgggggcgcgtggctgcagcggggcccgcgtggtgcctcctgaggcggcccccggatgaagagatctgggaacccgggagccgaggyaacgaacagctcggtggcagggcctgactgctgcggaggcctcggcaatattgattttagacaggcagacttctgcgttatgacccggctgctgggctac

SEQ ID NO: 10388 - DNA, 201 bp, Homo sapiens
cagggcctgactgctgcggaggcctcggcaatattgattttagacaggcagacttctgcgttatgacccggctgctgggctacgtggaccccctggatccyagctttgtggctgccgtcatcaccatcaccttcaatccgctctactggaatgtggttgcacgatgggaacacaagacccgcaagctgagcagggccttcg

SEQ ID NO: 10389 - DNA, 201 bp, Homo sapiens; identical to SEQ ID NO: 10384

SEQ ID NO: 10390 - DNA, 201 bp, Homo sapiens; identical to SEQ ID NO: 10385

SEQ ID NO: 10391 - DNA, 201 bp, Homo sapiens; identical to SEQ ID NO: 10386

SEQ ID NO: 10392 - DNA, 201 bp, Homo sapiens
gaaccggcaggctctgcggcgaaacacactgggacttgtagttctcggctcctctagacgctgtcgcgagcccccagataaagaggcacttcgcggtgacrgggaactacatttcccagaaggccggaatatgttgggggtcaccgggaaagcgccccgactggcggcacttacccggctctataggtccggttccggggg

SEQ ID NO: 10393 - DNA, 201 bp, Homo sapiens
acccccagaaataaaatggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatgtcccaccccagattggtga

SEQ ID NO: 10394 - DNA, 201 bp, Homo sapiens
ccactcaaacgctgacatgtacggtctatgccattcctcccccgcatcacatccactggtattggcagttggaggaagagtgcgccaacgagcccagccawgctgtctcagtgacaaacccatacccttgtgaagaatggagaagtgtggaggacttccagggaggaaataaaattgaagttaataaaaatcaatttgctc

SEQ ID NO: 10395 - DNA, 201 bp, Homo sapiens
ctgcaaatttggaaacctgtccacttacctgaggagcaagagaaatgaatttgtcccctacaagaccaaaggggcacgattccgtcaagggaaagactacrttggagcaatccctgtggatctgaaacggcgcttggacagcatcaccagtagccagagctcagccagctctggatttgtggaggagaagtccctcagtga

SEQ ID NO: 10396 - DNA, 201 bp, Homo sapiens
aggacttcctgaccttggagcatctcatctgttacagcttccaagtggctaagggcatggagttcttggcatcgcgaaagtgtatccacagggacctggcrgcacgaaatatcctcttatcggagaagaacgtggttaaaatctgtgactttggcttggcccgggatatttataaagatccagattatgtcagaaaaggag

SEQ ID NO: 10397 - DNA, 201 bp, Homo sapiens
ggcatgcagtgttcttggctgtgcaaaagtggaggcatttttcataatagaaggtgcccaggaaaagacgaacttggaaatcattattctagtaggcacgrcggtgattgccatgttcttctggctacttcttgtcatcatcctacggaccgttaagcgggccaatggaggggaactgaagacaggctacttgtccatcgt

SEQ ID NO: 10398 - DNA, 201 bp, Homo sapiens
ggctcagcatacaaaaagacatacttacaattaaggctaatacaactcttcaaattacttgcaggggacagagggacttggactggctttggcccaataawcagagtggcagtgagcaaagggtggaggtgactgagtgcagcgatggcctcttctgtaagacactcacaattccaaaagtgatcggaaatgacactggag

SEQ ID NO: 10399 - DNA, 201 bp, Homo sapiens
gagtgcaaaccggtagcacagcccagattctccagcctgactcggggaccacactgagctctcctcctgtttaaaaggaagcatccacacccccaactccyggacatcacatgagaggtgctgctcagattttcaagtgttgttctttccaccagcaggaagtagccgcatttgattttcatttcgacaacaaacaaagac

SEQ ID NO: 10400 - DNA, 201 bp, Homo sapiens
gcggctaccagtccggatatcactccgatgacacagacaccaccgtgtactccagtgaggaagcagaacttttaaagctgatagagattggagtgcaaacyggtagcacagcccagattctccagcctgactcggggaccacactgagctctcctcctgtttaaaaggaagcatccacacccccaactcccggacatcaca

SEQ ID NO: 10401 - DNA, 132 bp, Homo sapiens
actgagtcccgggaccccgggagagcggtcartgtgtggtcgctgcgtttcctctgcctgcgccgggcatcacttgcgcgccgcagaaagtccgtctggcagcctggatatcctctcctaccggcacccgca

SEQ ID NO: 10402 - DNA, 201 bp, Homo sapiens
ttcttcgaagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatgaaaaaccttttgt

SEQ ID NO: 10403 - DNA, 201 bp, Homo sapiens
agcctgactcggggaccacactgagctctcctcctgtttaaaaggaagcatccacacccccaactcccggacatcacatgagaggtgctgctcagattttsaagtgttgttctttccaccagcaggaagtagccgcatttgattttcatttcgacaacaaacaaagacgttcaagaaatggccccatcctcaaagaagtag

SEQ ID NO: 10404 - DNA, 201 bp, Homo sapiens
cacagacaccaccgtgtactccagtgaggaagcagaacttttaaagctgatagagattggagtgcaaaccggtagcacagcccagattctccagcctgacwcggggaccacactgagctctcctcctgtttaaaaggaagcatccacacccccaactcccggacatcacatgagaggtgctgctcagattttcaagtgttg

SEQ ID NO: 10405 - DNA, 201 bp, Homo sapiens
gaacattgtgaacgactgccttatgatgccagcaaatgggaattccccagagaccggctgaagctaggtaagcctcttggccgtggtgcctttggccaagwgattgaagcagatgcctttggaattgacaagacagcaacttgcaggacagtagcagtcaaaatgttgaaagaaggagcaacacacagtgagcatcgagct

SEQ ID NO: 10406 - DNA, 201 bp, Homo sapiens
aagaagaacagcacatttgtcagggtccatgaaaaaccttttgttgcttttggaagtggcatggaatctctggtggaagccacggtgggggagcgtgtcaraatccctgcgaagtaccttggttacccacccccagaaataaaatggtataaaaatggaataccccttgagtccaatcacacaattaaagcggggcatgta

SEQ ID NO: 10407 - DNA, 201 bp, Homo sapiens
tgccattcctcccccgcatcacatccactggtattggcagttggaggaagagtgcgccaacgagcccagccaagctgtctcagtgacaaacccataccctygtgaagaatggagaagtgtggaggacttccagggaggaaataaaattgaagttaataaaaatcaatttgctctaattgaaggaaaaaacaaaactgtaag

SEQ ID NO: 10408 - DNA, 201 bp, Homo sapiens; identical to SEQ ID NO: 10393

SEQ ID NO: 10409 - DNA, 201 bp, Homo sapiens; identical to SEQ ID NO: 10394

SEQ ID NO: 10410 - DNA, 201 bp, Homo sapiens; identical to SEQ ID NO: 10396

SEQ ID NO: 10411 - DNA, 201 bp, Homo sapiens; identical to SEQ ID NO: 10397

SEQ ID NO: 10412 - DNA, 201 bp, Homo sapiens; identical to SEQ ID NO: 10398

SEQ ID NO: 10413 - DNA, 201 bp, Homo sapiens; identical to SEQ ID NO: 10399

SEQ ID NO: 10414 - DNA, 201 bp, Homo sapiens; identical to SEQ ID NO: 10400

SEQ ID NO: 10415 - DNA, 132 bp, Homo sapiens; identical to SEQ ID NO: 10401

SEQ ID NO: 10416 - DNA, 201 bp, Homo sapiens; identical to SEQ ID NO: 10402

SEQ ID NO: 10417 - DNA, 201 bp, Homo sapiens; identical to SEQ ID NO: 10403

SEQ ID NO: 10418 - DNA, 201 bp, Homo sapiens; identical to SEQ ID NO: 10404

SEQ ID NO: 10419 - DNA, 201 bp, Homo sapiens; identical to SEQ ID NO: 10405

SEQ ID NO: 10420 - DNA, 201 bp, Homo sapiens; identical to SEQ ID NO: 10406

SEQ ID NO: 10421 - DNA, 201 bp, Homo sapiens; identical to SEQ ID NO: 10407

SEQ ID NO: 10422 - DNA, 201 bp, Homo sapiens; identical to SEQ ID NO: 10393

SEQ ID NO: 10423 - DNA, 201 bp, Homo sapiens; identical to SEQ ID NO: 10394

SEQ ID NO: 10424 - DNA, 201 bp, Homo sapiens; identical to SEQ ID NO: 10395

SEQ ID NO: 10425 - DNA, 201 bp, Homo sapiens; identical to SEQ ID NO: 10396

SEQ ID NO: 10426 - DNA, 201 bp, Homo sapiens; identical to SEQ ID NO: 10397

SEQ ID NO: 10427 - DNA, 201 bp, Homo sapiens; identical to SEQ ID NO: 10398

SEQ ID NO: 10428 - DNA, 201 bp, Homo sapiens
gagtgcaaaccggtagcacagcccagattctccagcctgactcggggaccacactgagctctcctcctgtttaaaaggaagcatccacacccccaactccyggacatcacatgagaggtgctgctcagattttcaagtgttgttctttccaccagcaggaagtagccgcatttgattttcatttcgacaacagaaaaagga

SEQ ID NO: 10429 - DNA, 201 bp, Homo sapiens; identical to SEQ ID NO: 10400

SEQ ID NO: 10430 - DNA, 132 bp, Homo sapiens; identical to SEQ ID NO: 10401

SEQ ID NO: 10431 - DNA, 201 bp, Homo sapiens; identical to SEQ ID NO: 10402

SEQ ID NO: 10432 - DNA, 201 bp, Homo sapiens
agcctgactcggggaccacactgagctctcctcctgtttaaaaggaagcatccacacccccaactcccggacatcacatgagaggtgctgctcagattttsaagtgttgttctttccaccagcaggaagtagccgcatttgattttcatttcgacaacagaaaaaggacctcggactgcagggagccagtcttctaggcat

SEQ ID NO: 10433 - DNA, 201 bp, Homo sapiens; identical to SEQ ID NO: 10404

SEQ ID NO: 10434 - DNA, 201 bp, Homo sapiens; identical to SEQ ID NO: 10405

SEQ ID NO: 10435 - DNA, 201 bp, Homo sapiens; identical to SEQ ID NO: 10406

SEQ ID NO: 10436 - DNA, 201 bp, Homo sapiens; identical to SEQ ID NO: 10407

SEQ ID NO: 10437 - DNA, 201 bp, Homo sapiens
tctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatca

SEQ ID NO: 10438 - DNA, 201 bp, Homo sapiens
gagagaagtccctgcaccacgaccaggaacacagcatgtcagtgcaaaccaggaactttccggaatgacaattctgctgagatgtgccggaagtgcagcasagggtgccccagagggatggtcaaggtcaaggattgtacgccctggagtgacatcgagtgtgtccacaaagaatcaggcaatggacataatatatgggtg

SEQ ID NO: 10439 - DNA, 201 bp, Homo sapiens
cgcgccccaggacccaggccggcgcgggaagccagccctcggctccgggtccacaagaccttcaagtttgtcgtcgtcggggtcctgctgcaggtcgtacstagctcagctgcaaccatcaaacttcatgatcaatcaattggcacacagcaatgggaacatagccctttgggagagttgtgtccaccaggatctcataga

SEQ ID NO: 10440 - DNA, 201 bp, Homo sapiens
aaaattaactggatgtgatggtgtgtgcatatattctcggctactcgggaggctgaggcaggagaatcacttgaacccacgaggcagtgagctgagattgyaccactgcactccagcctgggacacagagcaagactctgtctcaagataaaataaaataaacttgaaagaattattgcccgactgaggctcacatgccaa

SEQ ID NO: 10441 - DNA, 201 bp, Homo sapiens
gctgcaaccatcaaacttcatgatcaatcaattggcacacagcaatgggaacatagccctttgggagagttgtgtccaccaggatctcatagatcagaacrtcctggagcctgtaaccggtgcacagagggtgtgggttacaccaatgcttccaacaatttgtttgcttgcctcccatgtacagcttgtaaatcagatgaa

SEQ ID NO: 10442 - DNA, 129 bp, Homo sapiens
actccgaatgcgaagttctgtcttgtcayagccaagcacgctgcttcttggattgacctggcaggatggcgccaccaccagctagagtacatctaggtgcgttcctggcagtgactccgaatcccggga

SEQ ID NO: 10443 - DNA, 201 bp, Homo sapiens
catcggctcaggttgtggaggggaccccaagtgcatggacagggtgtgtttctggcgcttgggtctcctacgagggcctggggctgaggacaatgctcacmacgagattctgagcaacgcagactcgctgtccactttcgtctctgagcagcaaatggaaagccaggagccggcagatttgacaggtgtcactgtacagtc

SEQ ID NO: 10444 - DNA, 201 bp, Homo sapiens
aggatggcgccaccaccagctagagtacatctaggtgcgttcctggcagtgactccgaatcccgggagcgcagcgagtgggacagaggcagccgcggccayacccagcaaagtgtggggctcttccgcggggaggattgaaccacgaggcgggggccgaggagcgctccctacctccatgggacagcacggacccagtgcc

SEQ ID NO: 10445 - DNA, 201 bp, Homo sapiens
ttccggaatgacaattctgctgagatgtgccggaagtgcagcacagggtgccccagagggatggtcaaggtcaaggattgtacgccctggagtgacatcgmgtgtgtccacaaagaatcaggcaatggacataatatatgggtgattttggttgtgactttggttgttccgttgctgttggtggctgtgctgattgtctgt

SEQ ID NO: 10446 - DNA, 201 bp, Homo sapiens
ttgtatgcaatgctgatgaaatgggtcaacaaaactggacggaacgcctcgatccacaccctgctggatgccttggagaggatggaagagagacatgcaaragagaagattcaggacctcttggtggactctggaaagttcatctacttagaagatggcacaggctctgccgtgtccttggagtgaaagactctttttacc

SEQ ID NO: 10447 - DNA, 201 bp, Homo sapiens
gaggggaccccaagtgcatggacagggtgtgtttctggcgcttgggtctcctacgagggcctggggctgaggacaatgctcacaacgagattctgagcaaygcagactcgctgtccactttcgtctctgagcagcaaatggaaagccaggagccggcagatttgacaggtgtcactgtacagtccccaggggaggcacagt

SEQ ID NO: 10448 - DNA, 201 bp, Homo sapiens
cagcccctagaagggacatttccctgtgactttgcttggggagttgttgacaactacattcaagtagataccactctgtctcagtttaccgacctgaatgyttacctgtgggatgtccaccacagtaaaaggcttattaaagtggatggggttgtgaccaagaagaggaaatcctactgtgttgactttgctgccatccag

SEQ ID NO: 10449 - DNA, 201 bp, Homo sapiens
ggaaatgcacgttacacattttcgcttctccctggactgggccctgattctccctctgggtaaccagtcccaggtgaaccacaccatcctgcagtactatygctgcatggccagcgagcttgtccgtgtcaacatcaccccagtggtggccctgtggcagcctatggccccgaaccaaggactgccgcgcctcctggccag

SEQ ID NO: 10450 - DNA, 201 bp, Homo sapiens
accgagggcggctggcagcagcacggcaagggtgcgtccatctgggacacgttcacccaccaccccctggcacccccgggagactcccggaacgccagtckgccgttgggcgccccgtcgccgctgcagcccgccaccggggacgtagccagcgacagctacaacaacgtcttccgcgacacggaggcgctgcgcgagctc

SEQ ID NO: 10451 - DNA, 201 bp, Homo sapiens
actcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaagcccacatactggatggta

SEQ ID NO: 10452 - DNA, 201 bp, Homo sapiens
ttactgaatctgagaaaaagttcatcaaaggaactgctgacttttttgctctttgctttggacccaccttgagttttcaacttttggaccctcacatgaarttccgccaattggaatctcccaacctgaggcaactgctttcctggattgaccttgaatttaaccatcctcaaatatttattgtggaaaatggctggtttg

SEQ ID NO: 10453 - DNA, 201 bp, Homo sapiens
aaaagtttaggcatgctcagaatgggaaaatatccatagccttgcaggctgattggatagaacctgcctgccctttctcccaaaaggacaaagaggtggcygagagagttttggaatttgacattggctggctggctgagcccattttcggctctggagattatccatgggtgatgagggactggctgaaccaaagaaaca

SEQ ID NO: 10454 - DNA, 201 bp, Homo sapiens
tatcccgagagcatgaagaataacctttcatctattctgcctgattttactgaatctgagaaaaagttcatcaaaggaactgctgacttttttgctctttsctttggacccaccttgagttttcaacttttggaccctcacatgaagttccgccaattggaatctcccaacctgaggcaactgctttcctggattgacctt

SEQ ID NO: 10455 - DNA, 201 bp, Homo sapiens
ggcttattaaagtggatggggttgtgaccaagaagaggaaatcctactgtgttgactttgctgccatccagccccagatcgctttactccaggaaatgcaygttacacattttcgcttctccctggactgggccctgattctccctctgggtaaccagtcccaggtgaaccacaccatcctgcagtactatcgctgcatgg

SEQ ID NO: 10456 - DNA, 201 bp, Homo sapiens
atctctggactttgtactaggttggtttgccaaacccgtatttattgatggtgactatcccgagagcatgaagaataacctttcatctattctgcctgatkttactgaatctgagaaaaagttcatcaaaggaactgctgacttttttgctctttgctttggacccaccttgagttttcaacttttggaccctcacatgaa

SEQ ID NO: 10457 - DNA, 201 bp, Homo sapiens
agggcaccttccccgacggcttcctctgggccgtgggcagcgccgcctaccagaccgagggcggctggcagcagcacggcaagggtgcgtccatctgggayacgttcacccaccaccccctggcacccccgggagactcccggaacgccagtctgccgttgggcgccccgtcgccgctgcagcccgccaccggggacgtag

SEQ ID NO: 10458 - DNA, 152 bp, Homo sapiens
cgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtttctcgcggcct

SEQ ID NO: 10459 - DNA, 201 bp, Homo sapiens
ctttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactacattcaagtagataccactctgtctcagtttaccgacctgaatgttta

SEQ ID NO: 10460 - DNA, 201 bp, Homo sapiens
tgtactgagtgcagtttttttcacacccgaaagtctttactggctttcatagcttttctattttttgcttctattatttctctctcccttatattttactrctcgaagaaaggcagaagaagttacaaatagttctgaacatttttctattcattcattttgaaataattatgcagacacatcagctgttaaccatttgca

SEQ ID NO: 10461 - DNA, 201 bp, Homo sapiens
aaaagctgatagagaaaaatggcttccctcctttacctgaaaatcagcccctagaagggacatttccctgtgactttgcttggggagttgttgacaactayattcaagtagataccactctgtctcagtttaccgacctgaatgtttacctgtgggatgtccaccacagtaaaaggcttattaaagtggatggggttgtga

SEQ ID NO: 10462 - DNA, 201 bp, Homo sapiens
gccgccgccgccgtcgctgtcgctgctgctggtgctgctgggcctgggcggccgccgcctgcgtgcggagccgggcgacggcgcgcagacctgggcccgtktctcgcggcctcctgcccccgaggccgcgggcctcttccagggcaccttccccgacggcttcctctgggccgtgggcagcgccgcctaccagaccgaggg

SEQ ID NO: 10463 - DNA, 201 bp, Homo sapiens
tggctttaagccattataccaccatccttgtagactcagaaaaagaagatccaataaaatacaatgattacctagaagtgcaagaaatgaccgacatcacrtggctcaactcccccagtcaggtggcggtagtgccctgggggttgcgcaaagtgctgaactggctgaagttcaagtacggagacctccccatgtacataa

SEQ ID NO: 10464 - DNA, 201 bp, Homo sapiens
aaagtttaggcatgctcagaatgggaaaatatccatagccttgcaggctgattggatagaacctgcctgccctttctcccaaaaggacaaagaggtggccragagagttttggaatttgacattggctggctggctgagcccattttcggctctggagattatccatgggtgatgagggactggctgaaccaaagaaacaa

SEQ ID NO: 10465 - DNA, 201 bp, Homo sapiens; identical to SEQ ID NO: 10452

SEQ ID NO: 10466 - DNA, 201 bp, Homo sapiens; identical to SEQ ID NO: 10454

SEQ ID NO: 10467 - DNA, 201 bp, Homo sapiens; identical to SEQ ID NO: 10456

SEQ ID NO: 10468 - DNA, 201 bp, Homo sapiens; identical to SEQ ID NO: 10457

SEQ ID NO: 10469 - DNA, 201 bp, Homo sapiens; identical to SEQ ID NO: 10450

SEQ ID NO: 10470 - DNA, 152 bp, Homo sapiens; identical to SEQ ID NO: 10458

SEQ ID NO: 10471 - DNA, 201 bp, Homo sapiens
ctttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactacattcaagtaagtcagctgacaaaaccaatcagcagtctcaccaagcc

SEQ ID NO: 10472 - DNA, 201 bp, Homo sapiens; identical to SEQ ID NO: 10462

SEQ ID NO: 10473 - DNA, 155 bp, Homo sapiens
aaaagctgatagagaaaaatggcttccctcctttacctgaaaatcagcccctagaagggacatttccctgtgactttgcttggggagttgttgacaactayattcaagtaagtcagctgacaaaaccaatcagcagtctcaccaagccctatcac

SEQ ID NO: 10474 - DNA, 201 bp, Homo sapiens
gtgaccgagggctccctggaactcaaggatctccaggagcaaaaggggatgggggaattcctggtcctgctggtcccttaggtccacctggtcctccaggyttaccaggtcctcaaggcccaaagggtaacaaaggctctactggacccgctggccagaaaggtgacagtggtcttccagggcctcctgggcctccaggtc

SEQ ID NO: 10475 - DNA, 201 bp, Homo sapiens
ggctctgggatttcaccgtaacaaccctcgcattgaccttcctcttccaagctagagaggtcagaggagctgctccagttgatgtactaaaagcactagaktttcacaattctccagagggaatatcaaaaacaacgggattttgcacaaacagaaagaattctaaaggctcagatactgcttacagagtttcaaagcaag

SEQ ID NO: 10476 - DNA, 201 bp, Homo sapiens
ataccttggaaaggacgaagttggtctgcagtcgcaatttcgtgggttgagttcacagttgtgagtgcggggctcggagatggagccgtggtcctctaggkggaaaacgaaacggtggctctgggatttcaccgtaacaaccctcgcattgaccttcctcttccaagctagagaggtcagaggagctgctccagttgatgt

SEQ ID NO: 10477 - DNA, 201 bp, Homo sapiens
atactgaaggcatgcaagcagatgcagatgataatattcttgattactcggatggaatggaagaaatatttggttccctcaattccctgaaacaagacatygagcatatgaaatttccaatgggtactcagaccaatccagcccgaacttgtaaagacctgcaactcagccatcctgacttcccagatggtgaatattgga

SEQ ID NO: 10478 - DNA, 201 bp, Homo sapiens
gtgactcttcagcacccaaggctgctcaagctcaggaacctcagatagatgagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactagggg

SEQ ID NO: 10479 - DNA, 201 bp, Homo sapiens
ctggagaaaaaggtccccaagggcctgcagggagagatggagttcaaggtcctgttggtctcccagggccagctggtcctgccggctcccctggggaagayggagacaagggtgaaattggtgagccgggacaaaaaggcagcaagggtgacaagggagaaaatggccctcccggtcccccaggtcttcaaggaccagttg

SEQ ID NO: 10480 - DNA, 201 bp, Homo sapiens
  misc_feature (1)...(201): n = A,T,C or G, or insertion/deletion polymorphism (see Tables 1-2)
gctggacctccaggtgccaaggggccaccaggtgatgatggccctaagggtaacccgggtcctgttggttttcctggagatcctggtcctcctggggaacntggccctgcaggtcaagatggtgttggtggtgacaagggtgaagatggagatcctggtcaaccgggtcctcctggcccatctggtgaggctggcccacca

SEQ ID NO: 10481 - DNA, 201 bp, Homo sapiens
caggagaacctggggcaaagggagatcgagggtttgatggacttccgggtctgccaggtgacaaaggtcacaggggtgaacgaggtcctcaaggtcctccrggtcctcctggtgatgatggaatgaggggagaagatggagaaattggaccaagaggtcttccaggtgaagctggcccacgaggtttgctgggtccaaggg

SEQ ID NO: 10482 - DNA, 201 bp, Homo sapiens
cccaacaaatattacttttttcctttcaagataattttataaatcatttgacctacctaattgctaaatgaataacatatggtggactgttattaagagtrtttgttttaagtcattcaggaaaatctaaacttttttttccactaaggtatttactttaaggtagcttgaaatagcaatacaatttaaaaattaaaaact

SEQ ID NO: 10483 - DNA, 201 bp, Homo sapiens
gatttcaaggcaagaccggccctcctgggccagggggagtggttggaccacagggaccaaccggtgagactggtccaataggggaacgtgggcatcctggycctcctggccctcctggtgagcaaggtcttcctggtgctgcaggaaaagaaggtgcaaagggtgatccaggtcctcaaggtatctcagggaaagatggac

SEQ ID NO: 10484 - DNA, 201 bp, Homo sapiens
cgaaaccacttgatagaagtgagagagcaattgttgataccaatggaatcacggtttttggaacaaggattttggatgaagaagtttttgagggggacatycagcagtttttgatcacaggtgatcccaaggcagcatatgactactgtgagcattatagtccagactgtgactcttcagcacccaaggctgctcaagctc

SEQ ID NO: 10485 - DNA, 201 bp, Homo sapiens
ggagactggatttcaaggcaagaccggccctcctgggccagggggagtggttggaccacagggaccaaccggtgagactggtccaataggggaacgtgggyatcctggccctcctggccctcctggtgagcaaggtcttcctggtgctgcaggaaaagaaggtgcaaagggtgatccaggtcctcaaggtatctcagggaa

SEQ ID NO: 10486 - DNA, 201 bp, Homo sapiens
aggagaagttggtcaaattggcccaagaggggaagatggccctgaaggacccaaaggtcgagcaggcccaactggagacccaggtccttcaggtcaagcakgagaaaagggaaaacttggagttccaggattaccaggatatccaggaagacaaggtccaaagggttccactggattccctgggtttccaggtgccaatgg

SEQ ID NO: 10487 - DNA, 201 bp, Homo sapiens
tttaattggcctgattggtcctccaggagaacaaggggaaaaaggtgaccgagggctccctggaactcaaggatctccaggagcaaaaggggatgggggarttcctggtcctgctggtcccttaggtccacctggtcctccaggcttaccaggtcctcaaggcccaaagggtaacaaaggctctactggacccgctggcca

SEQ ID NO: 10488 - DNA, 201 bp, Homo sapiens
atccaaaaagtttacaccccccaaatctgaaaaattttcatccaagaagaagaaaagttatcaagcatcagcaaaagccaaactaggggtaaaggcaaacrtcgttgatgattttcaagaatacaactatggaacaatggaaagttaccagacagaagctcctaggcatgtttctgggacaaatgagccaaatccagttga

SEQ ID NO: 10489 - DNA, 201 bp, Homo sapiens
attggattgatcctaaccaaggttgctcaggagattccttcaaagtttactgtaatttcacatctggtggtgagacttgcatttatccagacaaaaaatckgagggagtaagaatttcatcatggccaaaggagaaaccaggaagttggtttagtgaatttaagaggggaaaactgctttcatacttagatgttgaaggaa

SEQ ID NO: 10490 - DNA, 201 bp, Homo sapiens
aagacaaagaacatatcaaatcaacagaaaatataccttggtgccaccaacccattttgtgccacatgcaagttttgaataaggatggtatagaaaacaaygctgcatatacaggtaccatttaggaaataccgatgcctttgtgggggcagaatcacatggcaaaagctttgaaaatcataaagatataagttggtgtgg

SEQ ID NO: 10491 - DNA, 201 bp, Homo sapiens
tacaccaaaaattgatcaagtacctattgttgatgtcatgatcaatgactttggtgatcagaatcagaagttcggatttgaagttggtcctgtttgttttyttggctaagattaagacaaagaacatatcaaatcaacagaaaatataccttggtgccaccaacccattttgtgccacatgcaagttttgaataaggatgg

SEQ ID NO: 10492 - DNA, 201 bp, Homo sapiens
acccattttgtgccacatgcaagttttgaataaggatggtatagaaaacaacgctgcatatacaggtaccatttaggaaataccgatgcctttgtgggggyagaatcacatggcaaaagctttgaaaatcataaagatataagttggtgtggctaagatggaaacagggctgattcttgattcccaattctcaactctcct

SEQ ID NO: 10493 - DNA, 195 bp, Homo sapiens
attaagagtatttgttttaagtcattcaggaaaatctaaacttttttttccactaaggtatttactttaaggtagcttgaaatagcaatacaatttaaaawttaaaaactgaattttgtatcttaattgataccagatttcactggaacagtttcaactgataatttatgacaaaagaacatacctgtaatattg

SEQ ID NO: 10494 - DNA, 201 bp, Homo sapiens
tagattttcttatcaatcaagttcttgaatttgattctaagttgcatattataacagtctcgaaaattattttacttgcccaacaaatattacttttttcytttcaagataattttataaatcatttgacctacctaattgctaaatgaataacatatggtggactgttattaagagtatttgttttaagtcattcaggaa

SEQ ID NO: 10495 - DNA, 201 bp, Homo sapiens
tgctctgagaggcccacctggcccaatgggtctaactggaagaccaggtcctgtgggggggcctggttcatctggggccaaaggtgagagtggtgatccargtcctcagggccctcgaggcgtccagggtccccctggtccaacgggaaaacctggaaaaaggggtcgtccaggtgcagatggaggaagaggaatgccagg

SEQ ID NO: 10496 - DNA, 201 bp, Homo sapiens
caaaacttgcacgtgtccctgaattccatctgactctaattttatgagaattgcagaactctgatggcaataaatatatgtattatgaaaaaataaagttrtaatttctgatgactctaagtccctttctttggttaataataaaatgcctttgtatatattgatgttgaagagttcaattatttgatgtcgccaacaaaa

SEQ ID NO: 10497 - DNA, 201 bp, Homo sapiens
tgtggctaagatggaaacagggctgattcttgattcccaattctcaactctccttttcctatttgaatttctttggtgctgtagaaaacaaaaaaagaaaratatatattcataaaaaatatggtgctcattctcatccatccaggatgtactaaaacagtgtgtttaataaattgtaattattttgtgtacagttctata

SEQ ID NO: 10498 - DNA, 201 bp, Homo sapiens
atctgtgtccatttccaaaacttgcacgtgtccctgaattccatctgactctaattttatgagaattgcagaactctgatggcaataaatatatgtattargaaaaaataaagttgtaatttctgatgactctaagtccctttctttggttaataataaaatgcctttgtatatattgatgttgaagagttcaattatttg

SEQ ID NO: 10499 - DNA, 201 bp, Homo sapiens
gtgaagtcattcagcctttaccaatcttgtcctccaaaaaaacgagaagacatactgaaggcatgcaagcagatgcagatgataatattcttgattactcrgatggaatggaagaaatatttggttccctcaattccctgaaacaagacattgagcatatgaaatttccaatgggtactcagaccaatccagcccgaactt

SEQ ID NO: 10500 - DNA, 201 bp, Homo sapiens
tctgtgtccatttccaaaacttgcacgtgtccctgaattccatctgactctaattttatgagaattgcagaactctgatggcaataaatatatgtattatraaaaaataaagttgtaatttctgatgactctaagtccctttctttggttaataataaaatgcctttgtatatattgatgttgaagagttcaattatttga

SEQ ID NO: 10501 - DNA, 201 bp, Homo sapiens
gagacacgaagaacgcaaaccatcaaatttagaagaaaaagccctttgactttttccccctctccctccccaatggctgtgtagcaaacatccctggcgawaccttggaaaggacgaagttggtctgcagtcgcaatttcgtgggttgagttcacagttgtgagtgcggggctcggagatggagccgtggtcctctaggtg

SEQ ID NO: 10502 - DNA, 201 bp, Homo sapiens
tcctccaggcttaccaggtcctcaaggcccaaagggtaacaaaggctctactggacccgctggccagaaaggtgacagtggtcttccagggcctcctgggyctccaggtccacctggtgaagtcattcagcctttaccaatcttgtcctccaaaaaaacgagaagacatactgaaggcatgcaagcagatgcagatgataa

SEQ ID NO: 10503 - DNA, 201 bp, Homo sapiens
tatgagaattgcagaactctgatggcaataaatatatgtattatgaaaaaataaagttgtaatttctgatgactctaagtccctttctttggttaataatraaatgcctttgtatatattgatgttgaagagttcaattatttgatgtcgccaacaaaattctcagagggcaaaaatctggaagacttttggaagcacact

SEQ ID NO: 10504 - DNA, 201 bp, Homo sapiens; identical to SEQ ID NO: 10474

SEQ ID NO: 10505 - DNA, 201 bp, Homo sapiens; identical to SEQ ID NO: 10475

SEQ ID NO: 10506 - DNA, 201 bp, Homo sapiens; identical to SEQ ID NO: 10476

SEQ ID NO: 10507 - DNA, 201 bp, Homo sapiens; identical to SEQ ID NO: 10477

SEQ ID NO: 10508 - DNA, 201 bp, Homo sapiens; identical to SEQ ID NO: 10479

SEQ ID NO: 10509 - DNA, 201 bp, Homo sapiens; identical to SEQ ID NO: 10481

SEQ ID NO: 10510 - DNA, 201 bp, Homo sapiens; identical to SEQ ID NO: 10480
  misc_feature (1)...(201): n = A,T,C or G, or insertion/deletion polymorphism (see Tables 1-2)

SEQ ID NO: 10511 - DNA, 201 bp, Homo sapiens; identical to SEQ ID NO: 10482

SEQ ID NO: 10512 - DNA, 201 bp, Homo sapiens; identical to SEQ ID NO: 10483

SEQ ID NO: 10513 - DNA, 201 bp, Homo sapiens; identical to SEQ ID NO: 10484

SEQ ID NO: 10514 - DNA, 201 bp, Homo sapiens; identical to SEQ ID NO: 10485

SEQ ID NO: 10515 - DNA, 201 bp, Homo sapiens; identical to SEQ ID NO: 10486

SEQ ID NO: 10516 - DNA, 201 bp, Homo sapiens
caaggcagcatatgactactgtgagcattatagtccagactgtgactcttcagcacccaaggctgctcaagctcaggaacctcagatagatgaggcaaacrtcgttgatgattttcaagaatacaactatggaacaatggaaagttaccagacagaagctcctaggcatgtttctgggacaaatgagccaaatccagttga

SEQ ID NO: 10517 - DNA, 201 bp, Homo sapiens; identical to SEQ ID NO: 10487

SEQ ID NO: 10518 - DNA, 201 bp, Homo sapiens; identical to SEQ ID NO: 10489

SEQ ID NO: 10519 - DNA, 201 bp, Homo sapiens; identical to SEQ ID NO: 10490

SEQ ID NO: 10520 - DNA, 201 bp, Homo sapiens; identical to SEQ ID NO: 10491

SEQ ID NO: 10521 - DNA, 201 bp, Homo sapiens; identical to SEQ ID NO: 10492

SEQ ID NO: 10522 - DNA, 201 bp, Homo sapiens; identical to SEQ ID NO: 10495

SEQ ID NO: 10523 - DNA, 201 bp, Homo sapiens
attaagagtatttgttttaagtcattcaggaaaatctaaacttttttttccactaaggtatttactttaaggtagcttgaaatagcaatacaatttaaaawttaaaaactgaattttgtatctattttaagtaatatatgtaagacttgaaaataaatgttttatttcttatataaagtgttaaattaattgataccagat

SEQ ID NO: 10524 - DNA, 201 bp, Homo sapiens; identical to SEQ ID NO: 10494

SEQ ID NO: 10525 - DNA, 201 bp, Homo sapiens; identical to SEQ ID NO: 10497

SEQ ID NO: 10526 - DNA, 201 bp, Homo sapiens; identical to SEQ ID NO: 10496

SEQ ID NO: 10527 - DNA, 201 bp, Homo sapiens; identical to SEQ ID NO: 10499

SEQ ID NO: 10528 - DNA, 201 bp, Homo sapiens; identical to SEQ ID NO: 10498

SEQ ID NO: 10529 - DNA, 201 bp, Homo sapiens; identical to SEQ ID NO: 10501

SEQ ID NO: 10530 - DNA, 201 bp, Homo sapiens; identical to SEQ ID NO: 10500

SEQ ID NO: 10531 - DNA, 201 bp, Homo sapiens; identical to SEQ ID NO: 10502

SEQ ID NO: 10532 - DNA, 201 bp, Homo sapiens; identical to SEQ ID NO: 10503

SEQ ID NO: 10533 - DNA, 201 bp, Homo sapiens; identical to SEQ ID NO: 10474

SEQ ID NO: 10534 - DNA, 201 bp, Homo sapiens; identical to SEQ ID NO: 10475

SEQ ID NO: 10535 - DNA, 201 bp, Homo sapiens; identical to SEQ ID NO: 10476

SEQ ID NO: 10536 - DNA, 201 bp, Homo sapiens; identical to SEQ ID NO: 10477

SEQ ID NO: 10537 - DNA, 201 bp, Homo sapiens; identical to SEQ ID NO: 10479

SEQ ID NO: 10538 - DNA, 201 bp, Homo sapiens; identical to SEQ ID NO: 10481

SEQ ID NO: 10539 - DNA, 201 bp, Homo sapiens; identical to SEQ ID NO: 10480
  misc_feature (1)...(201): n = A,T,C or G, or insertion/deletion polymorphism (see Tables 1-2)

SEQ ID NO: 10540 - DNA, 201 bp, Homo sapiens; identical to SEQ ID NO: 10482

SEQ ID NO: 10541 - DNA, 201 bp, Homo sapiens; identical to SEQ ID NO: 10483

SEQ ID NO: 10542 - DNA, 201 bp, Homo sapiens; identical to SEQ ID NO: 10484

SEQ ID NO: 10543 - DNA, 201 bp, Homo sapiens; identical to SEQ ID NO: 10485

SEQ ID NO: 10544 - DNA, 201 bp, Homo sapiens; identical to SEQ ID NO: 10486

SEQ ID NO: 10545 - DNA, 201 bp, Homo sapiens
atatgactatgagtatggggaagcagagtataaagaggctgaaagtgtaacagagggacccactgtaactgaggagacaatagcacagacggaggcaaacrtcgttgatgattttcaagaatacaactatggaacaatggaaagttaccagacagaagctcctaggcatgtttctgggacaaatgagccaaatccagttga

SEQ ID NO: 10546 - DNA, 201 bp, Homo sapiens; identical to SEQ ID NO: 10487

SEQ ID NO: 10547 - DNA, 201 bp, Homo sapiens; identical to SEQ ID NO: 10489

SEQ ID NO: 10548 - DNA, 201 bp, Homo sapiens; identical to SEQ ID NO: 10490

SEQ ID NO: 10549 - DNA, 201 bp, Homo sapiens; identical to SEQ ID NO: 10491

SEQ ID NO: 10550 - DNA, 201 bp, Homo sapiens; identical to SEQ ID NO: 10492

SEQ ID NO: 10551 - DNA, 201 bp, Homo sapiens; identical to SEQ ID NO: 10495

SEQ ID NO: 10552 - DNA, 195 bp, Homo sapiens; identical to SEQ ID NO: 10493

SEQ ID NO: 10553 - DNA, 201 bp, Homo sapiens; identical to SEQ ID NO: 10494

SEQ ID NO: 10554 - DNA, 201 bp, Homo sapiens; identical to SEQ ID NO: 10497

SEQ ID NO: 10555 - DNA, 201 bp, Homo sapiens; identical to SEQ ID NO: 10496

SEQ ID NO: 10556 - DNA, 201 bp, Homo sapiens; identical to SEQ ID NO: 10499

SEQ ID NO: 10557 - DNA, 201 bp, Homo sapiens; identical to SEQ ID NO: 10498

SEQ ID NO: 10558 - DNA, 201 bp, Homo sapiens; identical to SEQ ID NO: 10501

SEQ ID NO: 10559 - DNA, 201 bp, Homo sapiens; identical to SEQ ID NO: 10500

SEQ ID NO: 10560 - DNA, 201 bp, Homo sapiens; identical to SEQ ID NO: 10502

SEQ ID NO: 10561 - DNA, 201 bp, Homo sapiens; identical to SEQ ID NO: 10503

SEQ ID NO: 10562 - DNA, 201 bp, Homo sapiens; identical to SEQ ID NO: 10474

SEQ ID NO: 10563 - DNA, 201 bp, Homo sapiens; identical to SEQ ID NO: 10475

SEQ ID NO: 10564 - DNA, 201 bp, Homo sapiens; identical to SEQ ID NO: 10476

SEQ ID NO: 10565 - DNA, 201 bp, Homo sapiens; identical to SEQ ID NO: 10477

SEQ ID NO: 10566 - DNA, 201 bp, Homo sapiens; identical to SEQ ID NO: 10478

SEQ ID NO: 10567 - DNA, 201 bp, Homo sapiens; identical to SEQ ID NO: 10479

SEQ ID NO: 10568 - DNA, 201 bp, Homo sapiens; identical to SEQ ID NO: 10480
  misc_feature (1)...(201): n = A,T,C or G, or insertion/deletion polymorphism (see Tables 1-2)

SEQ ID NO: 10569 - DNA, 201 bp, Homo sapiens; identical to SEQ ID NO: 10481

SEQ ID NO: 10570 - DNA, 201 bp, Homo sapiens; identical to SEQ ID NO: 10482

SEQ ID NO: 10571 - DNA, 201 bp, Homo sapiens; identical to SEQ ID NO: 10483

SEQ ID NO: 10572 - DNA, 201 bp, Homo sapiens; identical to SEQ ID NO: 10484

SEQ ID NO: 10573 - DNA, 201 bp, Homo sapiens; identical to SEQ ID NO: 10485

SEQ ID NO: 10574 - DNA, 201 bp, Homo sapiens; identical to SEQ ID NO: 10486

SEQ ID NO: 10575 - DNA, 201 bp, Homo sapiens; identical to SEQ ID NO: 10487

SEQ ID NO: 10576 - DNA, 201 bp, Homo sapiens; identical to SEQ ID NO: 10488

SEQ ID NO: 10577 - DNA, 201 bp, Homo sapiens; identical to SEQ ID NO: 10489

SEQ ID NO: 10578 - DNA, 201 bp, Homo sapiens; identical to SEQ ID NO: 10490

SEQ ID NO: 10579 - DNA, 201 bp, Homo sapiens; identical to SEQ ID NO: 10491

SEQ ID NO: 10580 - DNA, 201 bp, Homo sapiens; identical to SEQ ID NO: 10492

SEQ ID NO: 10581 - DNA, 201 bp, Homo sapiens; identical to SEQ ID NO: 10523

SEQ ID NO: 10582 - DNA, 201 bp, Homo sapiens; identical to SEQ ID NO: 10494

SEQ ID NO: 10583 - DNA, 201 bp, Homo sapiens; identical to SEQ ID NO: 10495

SEQ ID NO: 10584 - DNA, 201 bp, Homo sapiens; identical to SEQ ID NO: 10496

SEQ ID NO: 10585 - DNA, 201 bp, Homo sapiens; identical to SEQ ID NO: 10497

SEQ ID NO: 10586 - DNA, 201 bp, Homo sapiens; identical to SEQ ID NO: 10498

SEQ ID NO: 10587 - DNA, 201 bp, Homo sapiens; identical to SEQ ID NO: 10499

SEQ ID NO: 10588 - DNA, 201 bp, Homo sapiens; identical to SEQ ID NO: 10500

SEQ ID NO: 10589 - DNA, 201 bp, Homo sapiens; identical to SEQ ID NO: 10501

SEQ ID NO: 10590 - DNA, 201 bp, Homo sapiens; identical to SEQ ID NO: 10502

SEQ ID NO: 10591 - DNA, 201 bp, Homo sapiens; identical to SEQ ID NO: 10503

SEQ ID NO: 10592 - DNA, 201 bp, Homo sapiens; identical to SEQ ID NO: 10474

SEQ ID NO: 10593 - DNA, 201 bp, Homo sapiens; identical to SEQ ID NO: 10475

SEQ ID NO: 10594 - DNA, 201 bp, Homo sapiens; identical to SEQ ID NO: 10476

SEQ ID NO: 10595 - DNA, 201 bp, Homo sapiens; identical to SEQ ID NO: 10477

SEQ ID NO: 10596 - DNA, 201 bp, Homo sapiens; identical to SEQ ID NO: 10479

SEQ ID NO: 10597 - DNA, 201 bp, Homo sapiens; identical to SEQ ID NO: 10481

SEQ ID NO: 10598 - DNA, 201 bp, Homo sapiens; identical to SEQ ID NO: 10480
  misc_feature (1)...(201): n = A,T,C or G, or insertion/deletion polymorphism (see Tables 1-2)

SEQ ID NO: 10599 - DNA, 201 bp, Homo sapiens; identical to SEQ ID NO: 10482

SEQ ID NO: 10600 - DNA, 201 bp, Homo sapiens; identical to SEQ ID NO: 10483

SEQ ID NO: 10601 - DNA, 201 bp, Homo sapiens; identical to SEQ ID NO: 10484

SEQ ID NO: 10602 - DNA, 201 bp, Homo sapiens; identical to SEQ ID NO: 10485

SEQ ID NO: 10603 - DNA, 201 bp, Homo sapiens; identical to SEQ ID NO: 10486

SEQ ID NO: 10604 - DNA, 201 bp, Homo sapiens; identical to SEQ ID NO: 10516

SEQ ID NO: 10605 - DNA, 201 bp, Homo sapiens; identical to SEQ ID NO: 10487

SEQ ID NO: 10606 - DNA, 201 bp, Homo sapiens; identical to SEQ ID NO: 10489

SEQ ID NO: 10607 - DNA, 201 bp, Homo sapiens; identical to SEQ ID NO: 10490

SEQ ID NO: 10608 - DNA, 201 bp, Homo sapiens; identical to SEQ ID NO: 10491

SEQ ID NO: 10609 - DNA, 201 bp, Homo sapiens; identical to SEQ ID NO: 10492

SEQ ID NO: 10610 - DNA, 201 bp, Homo sapiens; identical to SEQ ID NO: 10495

SEQ ID NO: 10611 - DNA, 195 bp, Homo sapiens; identical to SEQ ID NO: 10493

SEQ ID NO: 10612 - DNA, 201 bp, Homo sapiens; identical to SEQ ID NO: 10494

SEQ ID NO: 10613 - DNA, 201 bp, Homo sapiens; identical to SEQ ID NO: 10497

SEQ ID NO: 10614 - DNA, 201 bp, Homo sapiens; identical to SEQ ID NO: 10496

SEQ ID NO: 10615 - DNA, 201 bp, Homo sapiens; identical to SEQ ID NO: 10499

SEQ ID NO: 10616 - DNA, 201 bp, Homo sapiens; identical to SEQ ID NO: 10498

SEQ ID NO: 10617 - DNA, 201 bp, Homo sapiens; identical to SEQ ID NO: 10501

SEQ ID NO: 10618 - DNA, 201 bp, Homo sapiens; identical to SEQ ID NO: 10500

SEQ ID NO: 10619 - DNA, 201 bp, Homo sapiens; identical to SEQ ID NO: 10502

SEQ ID NO: 10620 - DNA, 201 bp, Homo sapiens; identical to SEQ ID NO: 10503

SEQ ID NO: 10621 - DNA, 201 bp, Homo sapiens; identical to SEQ ID NO: 10474

SEQ ID NO: 10622 - DNA, 201 bp, Homo sapiens; identical to SEQ ID NO: 10475

SEQ ID NO: 10623 - DNA, 201 bp, Homo sapiens; identical to SEQ ID NO: 10476

SEQ ID NO: 10624 - DNA, 201 bp, Homo sapiens; identical to SEQ ID NO: 10477

SEQ ID NO: 10625 - DNA, 201 bp, Homo sapiens; identical to SEQ ID NO: 10479

SEQ ID NO: 10626 - DNA, 201 bp, Homo sapiens; identical to SEQ ID NO: 10481

SEQ ID NO: 10627 - DNA, 201 bp, Homo sapiens; identical to SEQ ID NO: 10480
  misc_feature (1)...(201): n = A,T,C or G, or insertion/deletion polymorphism (see Tables 1-2)

SEQ ID NO: 10628 - DNA, 201 bp, Homo sapiens; identical to SEQ ID NO: 10482

SEQ ID NO: 10629 - DNA, 201 bp, Homo sapiens; identical to SEQ ID NO: 10483

SEQ ID NO: 10630 - DNA, 201 bp, Homo sapiens; identical to SEQ ID NO: 10484

SEQ ID NO: 10631 - DNA, 201 bp, Homo sapiens; identical to SEQ ID NO: 10485

SEQ ID NO: 10632 - DNA, 201 bp, Homo sapiens; identical to SEQ ID NO: 10486

SEQ ID NO: 10633 - DNA, 201 bp, Homo sapiens; identical to SEQ ID NO: 10545

SEQ ID NO: 10634 - DNA, 201 bp, Homo sapiens; identical to SEQ ID NO: 10487

SEQ ID NO: 10635 - DNA, 201 bp, Homo sapiens; identical to SEQ ID NO: 10489

SEQ ID NO: 10636 - DNA, 201 bp, Homo sapiens; identical to SEQ ID NO: 10490

SEQ ID NO: 10637 - DNA, 201 bp, Homo sapiens; identical to SEQ ID NO: 10491

SEQ ID NO: 10638 - DNA, 201 bp, Homo sapiens; identical to SEQ ID NO: 10492

SEQ ID NO: 10639 - DNA, 201 bp, Homo sapiens; identical to SEQ ID NO: 10495

SEQ ID NO: 10640 - DNA, 201 bp, Homo sapiens; identical to SEQ ID NO: 10523

SEQ ID NO: 10641 - DNA, 201 bp, Homo sapiens; identical to SEQ ID NO: 10494

SEQ ID NO: 10642 - DNA, 201 bp, Homo sapiens; identical to SEQ ID NO: 10497

SEQ ID NO: 10643 - DNA, 201 bp, Homo sapiens; identical to SEQ ID NO: 10496

SEQ ID NO: 10644 - DNA, 201 bp, Homo sapiens; identical to SEQ ID NO: 10499

SEQ ID NO: 10645 - DNA, 201 bp, Homo sapiens; identical to SEQ ID NO: 10498

SEQ ID NO: 10646 - DNA, 201 bp, Homo sapiens; identical to SEQ ID NO: 10501

SEQ ID NO: 10647 - DNA, 201 bp, Homo sapiens; identical to SEQ ID NO: 10500

SEQ ID NO: 10648 - DNA, 201 bp, Homo sapiens; identical to SEQ ID NO: 10502

SEQ ID NO: 10649 - DNA, 201 bp, Homo sapiens; identical to SEQ ID NO: 10503

SEQ ID NO: 10650 - DNA, 201 bp, Homo sapiens
cagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatgggtgctcctgctctgcactccagaaacaccctgacag

SEQ ID NO: 10651 - DNA, 105 bp, Homo sapiens
gcgcwcaccgagagccacttccggaacaagcgtcgcgtttctgaggagaaactcttggtgagaattcccagagtgataatggctacctacagcctggcgaacgag

SEQ ID NO: 10652 - DNA, 201 bp, Homo sapiens
gacaggctcagagaggagatggaaactgacatacccaacccacttcctcaaacacttcatgctgctgccccagccttcccgcagacttggcctaatgaaartacatacttcttcattcggagagacaaaacaagaactagagttttaatgataataaaagcaataataataaaagcaataacaataaaaacaagatcagac

SEQ ID NO: 10653 - DNA, 201 bp, Homo sapiens
tcactggggtaggcaagggactgaggaggtgaaaccaacccgtatggtgtcccagcacggcacctgctaaggagggagggtgggaaagcccaggccttcgytgcgggtacaggaggatgcaggagagggctgaggtgggggaggaacaactggtgtactgggagagagatttgggacgagggggaaccatcagcaaaaaat

SEQ ID NO: 10654 - DNA, 201 bp, Homo sapiens
tttgaggaagtgggttgggtatgtcagtttccatctcctctctgagcctgtcagggtgtttctggagtgcagagcaggagcaccctgctggagaggccaargcatagctgtgggcaggctcgggcttcagtttttccatgcccaccatttgcccctttgtcctagggtactttgaccagcagggtatgttggtgctcatac

SEQ ID NO: 10655 - DNA, 201 bp, Homo sapiens
gaaaccaccattcacactgcgggccacagtctggcagttgggcctgaggctggggagaaccagaagcagccggaaaaaaatgctggtcccacagccaggamatcagccacagtgccggtcctgtgcctcctggccatcatcttcatcctcaccgcagccctttcctatgtgctgtgcaagaggaggagggggcagtcaccg

SEQ ID NO: 10656 - DNA, 201 bp, Homo sapiens
attttttgctgatggttccccctcgtcccaaatctctctcccagtacaccagttgttcctcccccacctcagccctctcctgcatcctcctgtacccgcarcgaaggcctgggctttcccaccctccctccttagcaggtgccgtgctgggacaccatacgggttggtttcacctcctcagtcccttgcctaccccagtga

SEQ ID NO: 10657 - DNA, 201 bp, Homo sapiens
agccaagaatggaagtttgtgaggagacggactctatgttgcccaggctgttatggaactcctgagtcaagtgatcctcccaccttggcctctgaaggtgygaggattataggcgtcacctaccacatccagcctacacgtatttgttaatatctaacataggactaaccagccactgccctctcttaggcccctcattta

SEQ ID NO: 10658 - DNA, 201 bp, Homo sapiens
gcaagaggaggagggggcagtcaccgcagtcctctccagatctgccggttcattatatacctgtggcacctgactctaatacctgagccaagaatggaagyttgtgaggagacggactctatgttgcccaggctgttatggaactcctgagtcaagtgatcctcccaccttggcctctgaaggtgcgaggattataggcgt

SEQ ID NO: 10659 - DNA, 201 bp, Homo sapiens
aggcatagctgtgggcaggctcgggcttcagtttttccatgcccaccatttgcccctttgtcctagggtactttgaccagcagggtatgttggtgctcatmctccccaccctacatgttcccaggttctgtcccatggcacaggtgatggtctccctctcagctctgggtccatctccctggcctagttctccagcatctg

SEQ ID NO: 10660 - DNA, 201 bp, Homo sapiens
gttcaggaattgatgagctgtcttgatctcaaagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtagga

SEQ ID NO: 10661 - DNA, 201 bp, Homo sapiens
gtctgatcttgtttttattgttattgcttttattattattgcttttattatcattaaaactctagttcttgttttgtctctccgaatgaagaagtatgtaytttcattaggccaagtctgcgggaaggctggggcagcagcatgaagtgtttgaggaagtgggttgggtatgtcagtttccatctcctctctgagcctgtc

SEQ ID NO: 10662 - DNA, 201 bp, Homo sapiens
cggagtctcgctctgtcatccaggctggagtgcagtggcatgatctcggctcactgcaacccccatctcccaggttcaagcgattctcctgcctcctcctragtagctgggactacaggtgctcaccaccacacccggctaattttttgtatttttagtagagacggggtttcaccatgttgaccaggctggtctcgaact

SEQ ID NO: 10663 - DNA, 201 bp, Homo sapiens
catcggttcagttcatgaatcgtctccggaaacacctgagagcttaccatcggtgtctatactacacgaggttccagctcctttcctggagcgtgtgtggrggcaacaaggacccatgggttcaggaattgatgagctgtcttgatctcaaagaatgtggacatgcttactcggggattgtggcccaccagaagcatttac

SEQ ID NO: 10664 - DNA, 201 bp, Homo sapiens
ggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcg

SEQ ID NO: 10665 - DNA, 201 bp, Homo sapiens
ctgcgggccacagtctggcagttgggcctgaggctggggagaaccagaagcagccggaaaaaaatgctggtcccacagccaggacatcagccacagtgccrgtcctgtgcctcctggccatcatcttcatcctcaccgcagccctttcctatgtgctgtgcaagaggaggagggggcagtcaccgcagtcctctccagatc

SEQ ID NO: 10666 - DNA, 201 bp, Homo sapiens
ttcattatatacctgtggcacctgactctaatacctgagccaagaatggaagtttgtgaggagacggactctatgttgcccaggctgttatggaactcctragtcaagtgatcctcccaccttggcctctgaaggtgcgaggattataggcgtcacctaccacatccagcctacacgtatttgttaatatctaacatagga

SEQ ID NO: 10667 - DNA, 201 bp, Homo sapiens
cgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggcaatggcaacgagggcagcgtc

SEQ ID NO: 10668 - DNA, 201 bp, Homo sapiens
cagggcgcgggagctccacctcctcggctttccctgcgtccagaggctggcatggcgcgggccgagtactgagcgcacggtcggggcacagcagggccggkgggtgcagctggctcgcgcctcctctccggccgccgtctcctccggtccccggcgaaagccattgagacaccagctggacgtcacgcgccggagcatgtc

SEQ ID NO: 10669 - DNA, 201 bp, Homo sapiens
gacggagccgggcccagtgcgggggcgcagggcgcgggagctccacctcctcggctttccctgcgtccagaggctggcatggcgcgggccgagtactgagmgcacggtcggggcacagcagggccggggggtgcagctggctcgcgcctcctctccggccgccgtctcctccggtccccggcgaaagccattgagacacca

SEQ ID NO: 10670 - DNA, 201 bp, Homo sapiens
actcagcgccccaccctcccagtaggatcactgtcctcggacaaagagctcactcgtcccaatgaaaccaccattcacactgcgggccacagtctggcagytgggcctgaggctggggagaaccagaagcagccggaaaaaaatgctggtcccacagccaggacatcagccacagtgccggtcctgtgcctcctggccatc

SEQ ID NO: 10671 - DNA, 201 bp, Homo sapiens
cgacggagccgggcccagtgcgggggcgcagggcgcgggagctccacctcctcggctttccctgcgtccagaggctggcatggcgcgggccgagtactgarcgcacggtcggggcacagcagggccggggggtgcagctggctcgcgcctcctctccggccgccgtctcctccggtccccggcgaaagccattgagacacc

SEQ ID NO: 10672 - DNA, 201 bp, Homo sapiens
gatcaagatcactggcaccaaagagggcatcgagaaagctcgccatgaagtcttactcatctctgccgagcaggacaaacgtgctgtggagaggctagaartagaaaaggcattccaccccttcatcgctgggccgtataatagactggttggcgagatcatgcaggagacaggcacgcgcatcaacatccccccacccag

SEQ ID NO: 10673 - DNA, 201 bp, Homo sapiens
cccatctggagtgggagtgggcacttccaccccgcccacaggccatccggctgtgcaggccagcccctaggagcaggtcccgggtgactggcagttttcayggtctagggccgagacgatggcatggggcctagagcatgaggtagagcagaatgcagaccacgccgctggatgccgagagaccctgctctccgagggagg

SEQ ID NO: 10674 - DNA, 201 bp, Homo sapiens
tgtgtgttctctttctcgtcaccctggagtggtgactggcatctgtgggtagttcgtctttggtgtgattttctcagcagttctcaacactgtgttcaacrgcccctcgggagccacattgagggagacccaggtgtggtcatggcaagagggtggctgcctgtccctgtcctctggctgccagacagtcagcagttgccc

SEQ ID NO: 10675 - DNA, 201 bp, Homo sapiens
agattgctgaagagtatggcggggtgatggtcagcttcccacgctctggcacacagagcgacaaagtcaccctcaagggcgccaaggactgtgtggaggcrgccaagaaacgcattcaggagatcattgaggacctggaagctcaggtgacattagaatgtgctataccccagaaattccatcgatctgtcatgggcccca

SEQ ID NO: 10676 - DNA, 201 bp, Homo sapiens
tagaccccaaataccatcccaagattatcgggagaaagggggcagtaattacccaaatccggttggagcatgacgtgaacatccagtttcctgataaggaygatgggaaccagccccaggaccaaattaccatcacagggtacgaaaagaacacagaagctgccagggatgctatactgagaattgtgggtgaacttgagc

SEQ ID NO: 10677 - DNA, 201 bp, Homo sapiens
ggaccaccgcgttcacgcccgcatcattggtgcccgcggcaaagccattcgcaaaatcatggacgaattcaaggtggacattcgcttcccacagagcggasccccagaccccaactgcgtcactgtgacggggctcccagagaatgtggaggaagccatcgaccacatcctcaatctggaggaggaatacctagctgacgt

SEQ ID NO: 10678 - DNA, 201 bp, Homo sapiens
gaggagaacgcagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggcattggttcctgtcaccattgaagtagaggtg

SEQ ID NO: 10679 - DNA, 201 bp, Homo sapiens
ctctggccggaaagaaaagtgtgaggctgccaaggaagctctggaggcattggttcctgtcaccattgaagtagaggtgccctttgaccttcaccgttacrttattgggcagaaaggaagtgggatccgcaagatgatggatgagtttgaggtgaacatacatgtcccggcacctgagctgcagtctgacatcatcgccat

SEQ ID NO: 10680 - DNA, 201 bp, Homo sapiens
cagaacctggccaaaatcactcagcagatgccaaaggttcacatcgagttcacagagggcgaagacaagatcaccctggagggccctacagaggatgtcartgtggcccaggaacagatagaaggcatggtcaaagatttgattaaccggatggactatgtggagatcaacatcgaccacaagttccacaggcacctcatt

SEQ ID NO: 10681 - DNA, 201 bp, Homo sapiens
cagctttggggctcaggtggctcccaagaccctcccttggggccccaaacgataatgatcaaaaagaacagaaccctctccagccagcggctggaccctcygtaaattgttgacgctcttcccccttcccgaggtcccgcagggagcctagcgcctggctgtgtgtgcggccgctcctccaggcctggccgtgcccgctca

SEQ ID NO: 10682 - DNA, 201 bp, Homo sapiens
ttcccttggtccagacagtcctgtttgtggagtgcaatcagcctcctccagctgccagagcgcctcagcacaggtgtcagggtgcaaggaagacctggcartggacagcaggaggcaggttcctggagctggggggtgacctgagaggcagagggtgacgggttctcaggcagtcctgattttacctgccgtggggtctga

SEQ ID NO: 10683 - DNA, 201 bp, Homo sapiens
gcaccctggaccgccagcagcagtgagaaggctcctgacatgagcagctctgaggaatttcccagctttggggctcaggtggctcccaagaccctcccttkgggccccaaacgataatgatcaaaaagaacagaaccctctccagccagcggctggaccctccgtaaattgttgacgctcttcccccttcccgaggtcccg

SEQ ID NO: 10684 - DNA, 201 bp, Homo sapiens
atttgattaaccggatggactatgtggagatcaacatcgaccacaagttccacaggcacctcattgggaagagcggtgccaacataaacagaatcaaagaycagtacaaggtgtccgtgcgcatccctcctgacagtgagaagagcaatttgatccgcatcgagggggacccacagggcgtgcagcaggccaagcgagagc

SEQ ID NO: 10685 - DNA, 201 bp, Homo sapiens
cactctaaattcagaagaggagagcgaccctccaacctacaaggatgccttccctccacttcctgagaaagctgcttgcctggaaagtgcccaggaaccckctggagcctgggggaacaagatccgacccatcaaggcttctgtcatcactcaggtgttccatgtacccctggaggagagaaaatacaaggatatgaacca

SEQ ID NO: 10686 - DNA, 201 bp, Homo sapiens
actcacgcccatccatctcacagcccttccctggggacagtcgcttccgccttgacacctcactctcagttgaataactcaagcttggtcatcttcagackcgaattcttgagtagacccagacggcttagcccaagtctagttgcagctgcctcggcaagtccccatttgctcaggcagccctgaatgggcctgtttaca

SEQ ID NO: 10687 - DNA, 201 bp, Homo sapiens
tcaccctggagtggtgactggcatctgtgggtagttcgtctttggtgtgattttctcagcagttctcaacactgtgttcaacggcccctcgggagccacaytgagggagacccaggtgtggtcatggcaagagggtggctgcctgtccctgtcctctggctgccagacagtcagcagttgccctgcagccctcattgaggg

SEQ ID NO: 10688 - DNA, 201 bp, Homo sapiens
ctgtgtcatgctgtgagggctgaggacggggccctagtctctggttttctggtcttaacatccttatctgtgtccgccacggaggtgactgagctgctagygagttgtcctgtcccaggtacttgagttttggaaaagctgactcacgcccatccatctcacagcccttccctggggacagtcgcttccgccttgacacct

SEQ ID NO: 10689 - DNA, 201 bp, Homo sapiens
cctcggcaagtccccatttgctcaggcagccctgaatgggcctgtttacaggaatggtaaattgggattggaaggaatatagcttccagcttcataggctrgggtgaccacggcttaggaaacagggaaagaaagcaaggcccttttcctgcctttcccgggatctgtctactccacctccacgggggaggccagtgggga

SEQ ID NO: 10690 - DNA, 201 bp, Homo sapiens
ctgaggaatttcccagctttggggctcaggtggctcccaagaccctcccttggggccccaaacgataatgatcaaaaagaacagaaccctctccagccagyggctggaccctccgtaaattgttgacgctcttcccccttcccgaggtcccgcagggagcctagcgcctggctgtgtgtgcggccgctcctccaggcctgg

SEQ ID NO: 10691 - DNA, 201 bp, Homo sapiens
ataatgtggtggaagactccatgctggtggaccccaagcaccaccgccacttcgtcatccgcagaggccaggtcttgcgggagattgctgaagagtatggyggggtgatggtcagcttcccacgctctggcacacagagcgacaaagtcaccctcaagggcgccaaggactgtgtggaggcagccaagaaacgcattcagg

SEQ ID NO: 10692 - DNA, 142 bp, Homo sapiens
cacctccacgggggaggccagtggggaagggctgtcacctcttccccatctgcatgagttctggaactctgtcctgttggctgcttgcttccagctccccscaatctccatcgcagcgggttcctcctgtcttttctacagt

SEQ ID NO: 10693 - DNA, 201 bp, Homo sapiens; identical to SEQ ID NO: 10672

SEQ ID NO: 10694 - DNA, 201 bp, Homo sapiens; identical to SEQ ID NO: 10682

SEQ ID NO: 10695 - DNA, 125 bp, Homo sapiens
ccagtggggaagggctgtcacctcttccccatctgcatgagttctggaactctgtcctgttggctgcttgcttccagctccccccaatctccatcgcagcrggttcctcctgtcttttctacagt

SEQ ID NO: 10696 - DNA, 201 bp, Homo sapiens
gcaccctggaccgccagcagcagtgagaaggctcctgacatgagcagctctgaggaatttcccagctttggggctcaggtggctcccaagaccctcccttkgggccccaaacgataatgatcaaaaagaacagaaccctctccagcctgctgacccaaacccaaccacacaatggtttgtctcaatctgacccagcggctg

SEQ ID NO: 10697 - DNA, 201 bp, Homo sapiens
aggaatttcccagctttggggctcaggtggctcccaagaccctcccttggggccccaaacgataatgatcaaaaagaacagaaccctctccagcctgctgrcccaaacccaaccacacaatggtttgtctcaatctgacccagcggctggaccctccgtaaattgttgacgctcttcccccttcccgaggtcccgcaggga

SEQ ID NO: 10698 - DNA, 201 bp, Homo sapiens; identical to SEQ ID NO: 10684

SEQ ID NO: 10699 - DNA, 201 bp, Homo sapiens; identical to SEQ ID NO: 10685

SEQ ID NO: 10700 - DNA, 201 bp, Homo sapiens; identical to SEQ ID NO: 10686

SEQ ID NO: 10701 - DNA, 201 bp, Homo sapiens; identical to SEQ ID NO: 10673

SEQ ID NO: 10702 - DNA, 201 bp, Homo sapiens
ctttggggctcaggtggctcccaagaccctcccttggggccccaaacgataatgatcaaaaagaacagaaccctctccagcctgctgacccaaacccaacyacacaatggtttgtctcaatctgacccagcggctggaccctccgtaaattgttgacgctcttcccccttcccgaggtcccgcagggagcctagcgcctgg

SEQ ID NO: 10703 - DNA, 161 bp, Homo sapiens
cggcttctcccgcgcggggggcgagtaagccagcggcaggaccagcgggcgggggcccacraacacatgcctcactcctgtcagcagttccaccttttcatggttgaggagcacatgtggtcgccagcctcccatctccagagtcccctaaggcaagatcc

SEQ ID NO: 10704 - DNA, 201 bp, Homo sapiens; identical to SEQ ID NO: 10675

SEQ ID NO: 10705 - DNA, 201 bp, Homo sapiens; identical to SEQ ID NO: 10688

SEQ ID NO: 10706 - DNA, 201 bp, Homo sapiens; identical to SEQ ID NO: 10676

SEQ ID NO: 10707 - DNA, 201 bp, Homo sapiens; identical to SEQ ID NO: 10677

SEQ ID NO: 10708 - DNA, 201 bp, Homo sapiens
atttcccagctttggggctcaggtggctcccaagaccctcccttggggccccaaacgataatgatcaaaaagaacagaaccctctccagcctgctgacccraacccaaccacacaatggtttgtctcaatctgacccagcggctggaccctccgtaaattgttgacgctcttcccccttcccgaggtcccgcagggagcct

SEQ ID NO: 10709 - DNA, 201 bp, Homo sapiens; identical to SEQ ID NO: 10689

SEQ ID NO: 10710 - DNA, 201 bp, Homo sapiens; identical to SEQ ID NO: 10678

SEQ ID NO: 10711 - DNA, 201 bp, Homo sapiens
cccttggggccccaaacgataatgatcaaaaagaacagaaccctctccagcctgctgacccaaacccaaccacacaatggtttgtctcaatctgacccagyggctggaccctccgtaaattgttgacgctcttcccccttcccgaggtcccgcagggagcctagcgcctggctgtgtgtgcggccgctcctccaggcctgg

SEQ ID NO: 10712 - DNA, 201 bp, Homo sapiens; identical to SEQ ID NO: 10691

SEQ ID NO: 10713 - DNA, 201 bp, Homo sapiens; identical to SEQ ID NO: 10679

SEQ ID NO: 10714 - DNA, 201 bp, Homo sapiens; identical to SEQ ID NO: 10680

SEQ ID NO: 10715 - DNA, 201 bp, Homo sapiens
aaacgataatgatcaaaaagaacagaaccctctccagcctgctgacccaaacccaaccacacaatggtttgtctcaatctgacccagcggctggaccctcygtaaattgttgacgctcttcccccttcccgaggtcccgcagggagcctagcgcctggctgtgtgtgcggccgctcctccaggcctggccgtgcccgctca

SEQ ID NO: 10716 - DNA, 142 bp, Homo sapiens; identical to SEQ ID NO: 10692

SEQ ID NO: 10717 - DNA, 201 bp, Homo sapiens; identical to SEQ ID NO: 10672

SEQ ID NO: 10718 - DNA, 201 bp, Homo sapiens; identical to SEQ ID NO: 10682

SEQ ID NO: 10719 - DNA, 125 bp, Homo sapiens; identical to SEQ ID NO: 10695

SEQ ID NO: 10720 - DNA, 201 bp, Homo sapiens; identical to SEQ ID NO: 10696

SEQ ID NO: 10721 - DNA, 201 bp, Homo sapiens; identical to SEQ ID NO: 10697

SEQ ID NO: 10722 - DNA, 201 bp, Homo sapiens; identical to SEQ ID NO: 10684

SEQ ID NO: 10723 - DNA, 201 bp, Homo sapiens; identical to SEQ ID NO: 10685

SEQ ID NO: 10724 - DNA, 201 bp, Homo sapiens; identical to SEQ ID NO: 10686

SEQ ID NO: 10725 - DNA, 201 bp, Homo sapiens; identical to SEQ ID NO: 10673

SEQ ID NO: 10726 - DNA, 201 bp, Homo sapiens; identical to SEQ ID NO: 10702

SEQ ID NO: 10727 - DNA, 175 bp, Homo sapiens
gcctcggagcgtcccggcttctcccgcgcggggggcgagtaagccagcggcaggaccagcgggcgggggcccacracaaaagctggcaggctgacagaggcggcctcaggacggaccttctggctactgaccgttttgctgtggttttcccggattgtgtgtaggtgtgagatca

SEQ ID NO: 10728 - DNA, 201 bp, Homo sapiens; identical to SEQ ID NO: 10675

SEQ ID NO: 10729 - DNA, 201 bp, Homo sapiens; identical to SEQ ID NO: 10688

SEQ ID NO: 10730 - DNA, 201 bp, Homo sapiens; identical to SEQ ID NO: 10676

SEQ ID NO: 10731 - DNA, 201 bp, Homo sapiens; identical to SEQ ID NO: 10677

SEQ ID NO: 10732 - DNA, 201 bp, Homo sapiens; identical to SEQ ID NO: 10708

SEQ ID NO: 10733 - DNA, 201 bp, Homo sapiens; identical to SEQ ID NO: 10689

SEQ ID NO: 10734 - DNA, 201 bp, Homo sapiens; identical to SEQ ID NO: 10678

SEQ ID NO: 10735 - DNA, 201 bp, Homo sapiens; identical to SEQ ID NO: 10711

SEQ ID NO: 10736 - DNA, 201 bp, Homo sapiens; identical to SEQ ID NO: 10691

SEQ ID NO: 10737 - DNA, 201 bp, Homo sapiens; identical to SEQ ID NO: 10679

SEQ ID NO: 10738 - DNA, 201 bp, Homo sapiens; identical to SEQ ID NO: 10680

SEQ ID NO: 10739 - DNA, 201 bp, Homo sapiens; identical to SEQ ID NO: 10715

SEQ ID NO: 10740 - DNA, 201 bp, Homo sapiens
tgctcgaagaagagaattaggacctgctatccactgggagaggctatcagccagtcctgggacttggagacccagcatcctttgcattactttttccttcwggatgatctagagcagcatggagctgttggtagaatattagtttttaaccatacattgtcccaaaagtgtctgtgcattgtgcaaaaagtaaacttagga

SEQ ID NO: 10741 - DNA, 201 bp, Homo sapiens
atctcagtcaggataagctcacagatgtggccatcggggcccccctggaaggttttggggcagatgatggtgccagcttcggcagtgtgtatatctacaayggacactgggacggcctctccgccagcccctcgcagcggatcagagcctccacggtggccccaggactccagtacttcggcatgtccatggctggtggct

SEQ ID NO: 10742 - DNA, 162 bp, Homo sapiens
tctgtccccgcctcctggcctcctggctgaggggaagctgagtgggccacggcccatgtgtygcactcgcctcggctcccacacagccgcctctgctccagcaaggatgtggctcttccacactctgctctgcatagccagcctggccctgctggccgcttt

SEQ ID NO: 10743 - DNA, 103 bp, Homo sapiens
tagtttttaaccatacattgtcccaaaagtgtctgtgcattgtgcaaaaagtaaacttaggaaacatttggtattaaataaatttacacttttctttgcarta

SEQ ID NO: 10744 - DNA, 201 bp, Homo sapiens
gcggcggcagacgcggaggctgcgcagtacagctacctgggttacgctgtggccgtgctgcacaagacctgcagcctctcctacgtcgcgggggctccacrgtacaaacatcatggggccgtgtttgagctccagaaggagggcagagaggccagcttcctgccagtgctggagggagagcagatggggtcctattttggc

SEQ ID NO: 10745 - DNA, 201 bp, Homo sapiens
cacaaagaattcctcttccatgtacatggggagaacctctttggagcagaataccagttgcaaatttgcgtcccaaccaaattacgaggtctccaggttgyagcagtgaagaagctgacgaggactcaggcctccacggtgtgcacctggagtcaggagcgcgcttgtgcgtacagttcggttcagcatgtggaagaatgg

SEQ ID NO: 10746 - DNA, 201 bp, Homo sapiens
ctaactccggggaagattcctacatgacaagcatggccttgaattaccccagaaacctgcagttgaagaggatgcaaaagcctccctctccaaacattcastgtgatgaccctcagccggttgcttctgtcctgatcatgaactgcaggattggtcaccccgtcctcaagaggtcatctgctcatgtttcagtcgtttggc

SEQ ID NO: 10747 - DNA, 111 bp, Homo sapiens
tagaatattagtttttaaccatacattgtcccaaaagtgtctgtgcattgtgcaaaaagtaaacttaggaaacatttggtattaaataaatttacactttwctttgcagta

SEQ ID NO: 10748 - DNA, 201 bp, Homo sapiens
cctggaccgctacactgagccctttgccatcttccagctgccctatgagaaggcctgcaagaataagctgttttgtgtcgcagaattacagttggccaccrccgtctctcagcaggagttggtggtgggtctcacaaaggagctgaccctgaacattaacctaactaactccggggaagattcctacatgacaagcatggc

SEQ ID NO: 10749 - DNA, 201 bp, Homo sapiens
gtcatctgctcatgtttcagtcgtttggcagctagaggagaatgcctttccaaacaggacagcagacatcactgtgactgtcaccaattccaatgaaagayggtctttggccaacgagacccacacccttcaattcaggcatggcttcgttgcagttctgtccaaaccatccataatgtacgtgaacacaggccaggggct

SEQ ID NO: 10750 - DNA, 201 bp, Homo sapiens
ggccgtgctgcacaagacctgcagcctctcctacgtcgcgggggctccacggtacaaacatcatggggccgtgtttgagctccagaaggagggcagagagkccagcttcctgccagtgctggagggagagcagatggggtcctattttggctctgagctgtgccctgtggacattgacatggatggaagcacggacttctt

SEQ ID NO: 10751 - DNA, 201 bp, Homo sapiens
tgtagcagtgaagaagctgacgaggactcaggcctccacggtgtgcacctggagtcaggagcgcgcttgtgcgtacagttcggttcagcatgtggaagaakggcattcagtgagctgtgtcatcgcttcagataaagaaaatgtcaccgtggctgcagagatctcctgggatcactctgaggagttactaaaagatgtaac

SEQ ID NO: 10752 - DNA, 201 bp, Homo sapiens
tcacccccagcgcactgcccatcggcttcaacggcgtcgtgaatgtccgtttatgttttgaaatcagctctgtaaccacagcctctgagtcaggcctccgygaggcacttctcaacttcacgctggatgtggatgtggggaagcagaggagacggctgcagtgttcagacgtaagaagctgtctgggctgcctgagggagt

SEQ ID NO: 10753 - DNA, 201 bp, Homo sapiens
gaaccagacagcggcggcggcggcagacgcggaggctgcgcagtacagctacctgggttacgctgtggccgtgctgcacaagacctgcagcctctcctacrtcgcgggggctccacggtacaaacatcatggggccgtgtttgagctccagaaggagggcagagaggccagcttcctgccagtgctggagggagagcagat

SEQ ID NO: 10754 - DNA, 201 bp, Homo sapiens
cagagatctcctgggatcactctgaggagttactaaaagatgtaactgaactgcagatccttggtgaaatatctttcaacaaatctctatatgagggactkaatgcagagaaccacagaactaagatcactgtcgtcttcctgaaagatgagaagtaccattctttgcctatcatcattaaaggcagcgttggtggacttc

SEQ ID NO: 10755 - DNA, 201 bp, Homo sapiens
acagtaagatgggctcaacagtcactgccgctgttatcgggatcatcgtgcccatagtggtgatagccctcctgtgcatgagtggatacctgatctggagraactggaagcggaagaacaccaaaagcatgaattttgacaacccagtctacaggaaaacaacagaagaagaagacgaagatgagctccatatagggagaa

SEQ ID NO: 10756 - DNA, 201 bp, Homo sapiens
aattttgacaacccagtctacaggaaaacaacagaagaagaagacgaagatgagctccatatagggagaactgctcagattggccatgtctatcctgcacragtggcattaagccttgaagatgatggactaccctgaggatgggatcacccccttcgtgcctcatggaattcagtcccatgcactacactctggatggtg

SEQ ID NO: 10757 - DNA, 201 bp, Homo sapiens
ggaggatcgacctggtgaagcggaactattcacgcctcatccccatgctcaagaatgtcgtggcactagatgtggaagttgccaccaatcgcatctactgstgtgacctctcctaccgtaagatctatagcgcctacatggacaaggccagtgacccgaaagagcaggaggtcctcattgacgagcagttgcactctccag

SEQ ID NO: 10758 - DNA, 201 bp, Homo sapiens
caagagcccatccctaatcttcaccaaccggcacgaggtgcggaggatcgacctggtgaagcggaactattcacgcctcatccccatgctcaagaatgtcrtggcactagatgtggaagttgccaccaatcgcatctactggtgtgacctctcctaccgtaagatctatagcgcctacatggacaaggccagtgacccgaa

SEQ ID NO: 10759 - DNA, 201 bp, Homo sapiens
aaactggaagcggaagaacaccaaaagcatgaattttgacaacccagtctacaggaaaacaacagaagaagaagacgaagatgagctccatatagggagamctgctcagattggccatgtctatcctgcacaagtggcattaagccttgaagatgatggactaccctgaggatgggatcacccccttcgtgcctcatggaa

SEQ ID NO: 10760 - DNA, 201 bp, Homo sapiens
ccaggagcaggactgtccagatgggagtgatgaagctggctgcctacaggggctgaacgagtgtctgcacaacaatggcggctgctcacacatctgcactsacctcaagattggctttgaatgcacgtgcccagcaggcttccagctcctggaccagaagacctgtggcgacattgatgagtgcaaggacccagatgcctg

SEQ ID NO: 10761 - DNA, 115 bp, Homo sapiens
tcatggaattcagtcccatgcactacactctggatggtgacacttgggttgaattcagtaagtttcctctgaagcaccctgaagggtgccatccttacagwgctaagtggagacg

SEQ ID NO: 10762 - DNA, 201 bp, Homo sapiens
gcagccagatctgtgtcaattacaagggctattttaagtgtgagtgctaccctggctacgagatggacctactgaccaagaactgcaaggctgctgctggmaagagcccatccctaatcttcaccaaccggcacgaggtgcggaggatcgacctggtgaagcggaactattcacgcctcatccccatgctcaagaatgtcg

SEQ ID NO: 10763 - DNA, 201 bp, Homo sapiens
ctgtgccttcctgctcctcagatctccagccactctcccaagtacacatgtgcctgtcctgacacaatgtggctgggtccagacatgaagaggtgctaccragatgcaaatgaagacagtaagatgggctcaacagtcactgccgctgttatcgggatcatcgtgcccatagtggtgatagccctcctgtgcatgagtgga

SEQ ID NO: 10764 - DNA, 201 bp, Homo sapiens
gcatgagtggatacctgatctggagaaactggaagcggaagaacaccaaaagcatgaattttgacaacccagtctacaggaaaacaacagaagaagaagaygaagatgagctccatatagggagaactgctcagattggccatgtctatcctgcacaagtggcattaagccttgaagatgatggactaccctgaggatggg

SEQ ID NO: 10765 - DNA, 201 bp, Homo sapiens
acgctgatctcctccactgacttcctgagccacccttttgggatagctgtgtttgaggacaaggtgttctggacagacctggagaacgaggccattttcastgcaaatcggctcaatggcctggaaatctccatcctggctgagaacctcaacaacccacatgacattgtcatcttccatgagctgaagcagccaagagct

SEQ ID NO: 10766 - DNA, 201 bp, Homo sapiens
actggtgtcagacaatattgaatggcccaacggaatcaccctggatctgctgagccagcgcttgtactgggtagactccaagctacaccaactgtccagcmttgacttcagtggaggcaacagaaagacgctgatctcctccactgacttcctgagccacccttttgggatagctgtgtttgaggacaaggtgttctggac

SEQ ID NO: 10767 - DNA, 201 bp, Homo sapiens
cgctgctgctgctgctgctgctgctgctgctgctgcagctccagcatcttgcggcggcagcggctgatccgctgctcggcggccaagggccggccaaggaktgcgaaaaggaccaattccagtgccggaacgagcgctgcatcccctctgtgtggagatgcgacgaggacgatgactgcttagaccacagcgacgaggacg

SEQ ID NO: 10768 - DNA, 201 bp, Homo sapiens
cgcggcggccggagccccgggcccgccatgggcctccccgagccgggccctctccggcttctggcgctgctgctgctgctgctgctgctgctgctgctgcrgctccagcatcttgcggcggcagcggctgatccgctgctcggcggccaagggccggccaaggagtgcgaaaaggaccaattccagtgccggaacgagcgc

SEQ ID NO: 10769 - DNA, 201 bp, Homo sapiens; identical to SEQ ID NO: 10755

SEQ ID NO: 10770 - DNA, 201 bp, Homo sapiens; identical to SEQ ID NO: 10757

SEQ ID NO: 10771 - DNA, 201 bp, Homo sapiens; identical to SEQ ID NO: 10758

SEQ ID NO: 10772 - DNA, 201 bp, Homo sapiens; identical to SEQ ID NO: 10760

SEQ ID NO: 10773 - DNA, 201 bp, Homo sapiens
agttcagctctttgagtaacttcttcaatttctttcaggacacttgggttgaattcagtaagtttcctctgaagcaccctgaagggtgccatccttacagwgctaagtggagacgtttccagatcagcccaagtttactatagagactggcccaggcactgaatgtctaggacatgctgtggatgaagataaagatggtgg

SEQ ID NO: 10774 - DNA, 201 bp, Homo sapiens
gaaggtcagtgtacagacattccatggtaccagagtgctcagaaactcaagataggatatgcctcaccctcagctactccttgttttaaagttcagctctytgagtaacttcttcaatttctttcaggacacttgggttgaattcagtaagtttcctctgaagcaccctgaagggtgccatccttacagagctaagtggag

SEQ ID NO: 10775 - DNA, 201 bp, Homo sapiens
tgcaattatgtagtaaaaaaggcaaatcttttcacctctggctattcctgagaccccaggaagtcaggaaaagcctttcagctcacccatggctgctgtgmctcctaccagggctttcttggctttggcgaaggtcagtgtacagacattccatggtaccagagtgctcagaaactcaagataggatatgcctcaccctca

SEQ ID NO: 10776 - DNA, 201 bp, Homo sapiens
ctgtgccttcctgctcctcagatctccagccactctcccaagtacacatgtgcctgtcctgacacaatgtggctgggtccagacatgaagaggtgctaccragcacctcaatctacctcaactacgacgttagcttctaccatgacgaggacagtacctgccaccacaagagcccccgggaccaccgtccacagatccacc

SEQ ID NO: 10777 - DNA, 201 bp, Homo sapiens; identical to SEQ ID NO: 10765

SEQ ID NO: 10778 - DNA, 201 bp, Homo sapiens
agtttttctatgtataatgttttatacactttttaactggttgcactacccatgaggaattcgtggaatggctactgctgactaacatgatgcacataacyaaatgggggccaatggcacagtaccttactcatcatttaaaaactatatttacagaagatgtttggttgctgggggggcttttttaggttttggggcatt

SEQ ID NO: 10779 - DNA, 201 bp, Homo sapiens; identical to SEQ ID NO: 10766

SEQ ID NO: 10780 - DNA, 201 bp, Homo sapiens
tccacagatccacctaccagaaccacagcacagagacaccaagcctgacagctgcagtcccaagctcagttagtgtccccagggctcccagcatcagcccrtctaccctaagccctgcaaccagcaaccactcccagcactatgcaaatgaagacagtaagatgggctcaacagtcactgccgctgttatcgggatcatcg

SEQ ID NO: 10781 - DNA, 201 bp, Homo sapiens
gccctcaaggagctttttgtcttgccgggggaaccaaggtcacagctgcaccaactcccgaagaaccctctttccgagctgcctgtcgtcaaatccaagcragtggcattaagccttgaagatgatggactaccctgaggatgggatcacccccttcgtgcctcatggaattcagtcccatgcactacactctggatggtg

SEQ ID NO: 10782 - DNA, 201 bp, Homo sapiens
aaactggaagcggaagaacaccaaaagcatgaattttgacaacccagtctacaggaaaacaacagaagaagaagacgaagatgagctccatatagggagamctgctcagattggccatgtctatcctgcagcaatcagcagctttgatcgcccactgtgggcagagccctgtcttggggagaccagagaaccggaagaccc

SEQ ID NO: 10783 - DNA, 201 bp, Homo sapiens; identical to SEQ ID NO: 10762

SEQ ID NO: 10784 - DNA, 201 bp, Homo sapiens
atgatgcacataaccaaatgggggccaatggcacagtaccttactcatcatttaaaaactatatttacagaagatgtttggttgctgggggggcttttttrggttttggggcatttgttttttgtaaataagatgattatgctttgtggctatccatcaacataagtaaaaaaaaaaaaaaaacacttcaactccctcccc

SEQ ID NO: 10785 - DNA, 201 bp, Homo sapiens
ctttcagctcacccatggctgctgtgactcctaccagggctttcttggctttggcgaaggtcagtgtacagacattccatggtaccagagtgctcagaaastcaagataggatatgcctcaccctcagctactccttgttttaaagttcagctctttgagtaacttcttcaatttctttcaggacacttgggttgaattca

SEQ ID NO: 10786 - DNA, 201 bp, Homo sapiens
atggctactgttcaaatacataaagataaatttattttcacacagtccacaaggggtatatcttgtagttttcagaaaagcctttggaaatctggatcagraaatagataccatggtttgtgcaattatgtagtaaaaaaggcaaatcttttcacctctggctattcctgagaccccaggaagtcaggaaaagcctttcag

SEQ ID NO: 10787 - DNA, 201 bp, Homo sapiens
gcatgagtggatacctgatctggagaaactggaagcggaagaacaccaaaagcatgaattttgacaacccagtctacaggaaaacaacagaagaagaagaygaagatgagctccatatagggagaactgctcagattggccatgtctatcctgcagcaatcagcagctttgatcgcccactgtgggcagagccctgtcttg

SEQ ID NO: 10788 - DNA, 201 bp, Homo sapiens
gcggcgatggcggcggcgcctgcatcccggagcgctgggtctgcgaccgccagtttgactgcgaggaccgctcggacgaggcagccgagctctgcggccgyccgggccccggggccacgtccgcgcccgccgcctgcgccaccgcctcccagttcgcctgccgcagcggcgagtgcgtgcacctgggctggcgctgcgacg

SEQ ID NO: 10789 - DNA, 201 bp, Homo sapiens
tttatgtggggaaacattttaaggtaataaataggttacttaccatcatatgttcatatagatgaaactaatttttggcttaagtcagaacaactggccamaattgaagtcatatttgaggggggaaatggcatacgcaatattatattatattggatatttatgttcacacaggaatttggtttactgctttgtaaataa

SEQ ID NO: 10790 - DNA, 201 bp, Homo sapiens; identical to SEQ ID NO: 10767

SEQ ID NO: 10791 - DNA, 201 bp, Homo sapiens; identical to SEQ ID NO: 10768

SEQ ID NO: 10792 - DNA, 201 bp, Homo sapiens
ttaaggtaataaataggttacttaccatcatatgttcatatagatgaaactaatttttggcttaagtcagaacaactggccaaaattgaagtcatatttgwggggggaaatggcatacgcaatattatattatattggatatttatgttcacacaggaatttggtttactgctttgtaaataaaaggaaaaactccgggta

SEQ ID NO: 10793 - DNA, 201 bp, Homo sapiens
gaagtcatatttgaggggggaaatggcatacgcaatattatattatattggatatttatgttcacacaggaatttggtttactgctttgtaaataaaaggraaaactccgggtatatgtatagatgttcttcattatagacatcttctttgcttttcttggccttgggggaggaagggagaagtgctcttttctacttgtg

SEQ ID NO: 10794 - DNA, 201 bp, Homo sapiens
aaaaaaaaaaaaaaacacttcaactccctcccccatttagattatttattaacatattttaaaaatcagatgagttctataaataatttagagaagtgagrgtatttatttttggcatgtttggcccaccacacagactctgtgtgtgtatgtgtgtgtttatatgtgtatgtgtgtgacagaaaaatctgtagagaagag

SEQ ID NO: 10795 - DNA, 201 bp, Homo sapiens; identical to SEQ ID NO: 10755

SEQ ID NO: 10796 - DNA, 201 bp, Homo sapiens; identical to SEQ ID NO: 10757

SEQ ID NO: 10797 - DNA, 201 bp, Homo sapiens; identical to SEQ ID NO: 10758

SEQ ID NO: 10798 - DNA, 201 bp, Homo sapiens; identical to SEQ ID NO: 10760

SEQ ID NO: 10799 - DNA, 201 bp, Homo sapiens; identical to SEQ ID NO: 10773

SEQ ID NO: 10800 - DNA, 201 bp, Homo sapiens; identical to SEQ ID NO: 10774

SEQ ID NO: 10801 - DNA, 201 bp, Homo sapiens; identical to SEQ ID NO: 10775

SEQ ID NO: 10802 - DNA, 201 bp, Homo sapiens; identical to SEQ ID NO: 10763

SEQ ID NO: 10803 - DNA, 201 bp, Homo sapiens; identical to SEQ ID NO: 10765

SEQ ID NO: 10804 - DNA, 201 bp, Homo sapiens; identical to SEQ ID NO: 10778

SEQ ID NO: 10805 - DNA, 201 bp, Homo sapiens; identical to SEQ ID NO: 10766

SEQ ID NO: 10806 - DNA, 201 bp, Homo sapiens; identical to SEQ ID NO: 10756

SEQ ID NO: 10807 - DNA, 201 bp, Homo sapiens; identical to SEQ ID NO: 10759

SEQ ID NO: 10808 - DNA, 201 bp, Homo sapiens; identical to SEQ ID NO: 10762

SEQ ID NO: 10809 - DNA, 201 bp, Homo sapiens; identical to SEQ ID NO: 10784

SEQ ID NO: 10810 - DNA, 201 bp, Homo sapiens; identical to SEQ ID NO: 10785

SEQ ID NO: 10811 - DNA, 201 bp, Homo sapiens; identical to SEQ ID NO: 10786

SEQ ID NO: 10812 - DNA, 201 bp, Homo sapiens; identical to SEQ ID NO: 10764

SEQ ID NO: 10813 - DNA, 201 bp, Homo sapiens; identical to SEQ ID NO: 10789

SEQ ID NO: 10814 - DNA, 201 bp, Homo sapiens; identical to SEQ ID NO: 10768

SEQ ID NO: 10815 - DNA, 201 bp, Homo sapiens; identical to SEQ ID NO: 10767

SEQ ID NO: 10816 - DNA, 201 bp, Homo sapiens; identical to SEQ ID NO: 10792

SEQ ID NO: 10817 - DNA, 201 bp, Homo sapiens; identical to SEQ ID NO: 10793

SEQ ID NO: 10818 - DNA, 201 bp, Homo sapiens; identical to SEQ ID NO: 10794

SEQ ID NO: 10819 - DNA, 201 bp, Homo sapiens; identical to SEQ ID NO: 10755

SEQ ID NO: 10820 - DNA, 201 bp, Homo sapiens; identical to SEQ ID NO: 10757

SEQ ID NO: 10821 - DNA, 201 bp, Homo sapiens; identical to SEQ ID NO: 10758

SEQ ID NO: 10822 - DNA, 201 bp, Homo sapiens
cggggagaaggactgcgagggtggagcggatgaggccggctgtgctacctggctgaacgagtgtctgcacaacaatggcggctgctcacacatctgcactsacctcaagattggctttgaatgcacgtgcccagcaggcttccagctcctggaccagaagacctgtggcgacattgatgagtgcaaggacccagatgcctg

SEQ ID NO: 10823 - DNA, 201 bp, Homo sapiens; identical to SEQ ID NO: 10773

SEQ ID NO: 10824 - DNA, 201 bp, Homo sapiens; identical to SEQ ID NO: 10774

SEQ ID NO: 10825 - DNA, 201 bp, Homo sapiens; identical to SEQ ID NO: 10775

SEQ ID NO: 10826 - DNA, 201 bp, Homo sapiens; identical to SEQ ID NO: 10776

SEQ ID NO: 10827 - DNA, 201 bp, Homo sapiens; identical to SEQ ID NO: 10765

SEQ ID NO: 10828 - DNA, 201 bp, Homo sapiens; identical to SEQ ID NO: 10778

SEQ ID NO: 10829 - DNA, 201 bp, Homo sapiens; identical to SEQ ID NO: 10766

SEQ ID NO: 10830 - DNA, 201 bp, Homo sapiens; identical to SEQ ID NO: 10780

SEQ ID NO: 10831 - DNA, 201 bp, Homo sapiens; identical to SEQ ID NO: 10781

SEQ ID NO: 10832 - DNA, 201 bp, Homo sapiens; identical to SEQ ID NO: 10782

SEQ ID NO: 10833 - DNA, 201 bp, Homo sapiens; identical to SEQ ID NO: 10762

SEQ ID NO: 10834 - DNA, 201 bp, Homo sapiens; identical to SEQ ID NO: 10784

SEQ ID NO: 10835 - DNA, 201 bp, Homo sapiens; identical to SEQ ID NO: 10785

SEQ ID NO: 10836 - DNA, 201 bp, Homo sapiens; identical to SEQ ID NO: 10786

SEQ ID NO: 10837 - DNA, 201 bp, Homo sapiens; identical to SEQ ID NO: 10787

SEQ ID NO: 10838 - DNA, 201 bp, Homo sapiens; identical to SEQ ID NO: 10789

SEQ ID NO: 10839 - DNA, 201 bp, Homo sapiens; identical to SEQ ID NO: 10767

SEQ ID NO: 10840 - DNA, 201 bp, Homo sapiens; identical to SEQ ID NO: 10768

SEQ ID NO: 10841 - DNA, 201 bp, Homo sapiens; identical to SEQ ID NO: 10792

SEQ ID NO: 10842 - DNA, 201 bp, Homo sapiens; identical to SEQ ID NO: 10793

SEQ ID NO: 10843 - DNA, 201 bp, Homo sapiens; identical to SEQ ID NO: 10794

SEQ ID NO: 10844 - DNA, 201 bp, Homo sapiens
taaagttatagaagcagatgatctgttaatttcctatctaataaatgcctttaattgttctcataatgaagaataagtaggtatccctccatgcccttctrtaataaatatctggaaaaaacattaaacaataggcaaatatatgttatgtgcatttctagaaatacataacacatatatatgtctgtatcttatattcaa

SEQ ID NO: 10845 - DNA, 201 bp, Homo sapiens
tggatgtgaatgaggagggcactgaagcagccgctggcacaggaggtgttatgacagggagaactggacatggaggcccacagtttgtggcagatcatccktttctttttcttattatgcataagataaccaactgcattttatttttcggcagattttcctcaccctaaaactaagcgtgctgcttctgcaaaagatttt

SEQ ID NO: 10846 - DNA, 201 bp, Homo sapiens
ctggcacaggaggtgttatgacagggagaactggacatggaggcccacagtttgtggcagatcatccttttctttttcttattatgcataagataaccaastgcattttatttttcggcagattttcctcaccctaaaactaagcgtgctgcttctgcaaaagatttttgtagatgagctgtgtgcctcagaattgctatt

SEQ ID NO: 10847 - DNA, 201 bp, Homo sapiens
aaagtgtcaataagctgtttggtgagaagtctgcgagcttccgggaagaatatattcgactctgtcagaaatattactcctcagaaccccaggcagtagayttcctagaatgtgcagaagaagctagaaaaaagattaattcctgggtcaagactcaaaccaaaggcaaaatcccaaacttgttacctgaaggttctgtag

SEQ ID NO: 10848 - DNA, 201 bp, Homo sapiens
agaactggacatggaggcccacagtttgtggcagatcatccttttctttttcttattatgcataagataaccaactgcattttatttttcggcagattttsctcaccctaaaactaagcgtgctgcttctgcaaaagatttttgtagatgagctgtgtgcctcagaattgctatttcaaattgccaaaaatttagagatgt

SEQ ID NO: 10849 - DNA, 201 bp, Homo sapiens
agtttgtggcagatcatccttttctttttcttattatgcataagataaccaactgcattttatttttcggcagattttcctcaccctaaaactaagcgtgytgcttctgcaaaagatttttgtagatgagctgtgtgcctcagaattgctatttcaaattgccaaaaatttagagatgttttctacatatttctgctcttc

SEQ ID NO: 10850 - DNA, 201 bp, Homo sapiens
gatggccaagaattccttctttcttttcaaggcacaagctgcagataaaatccattcatccttccgctctctcagctctgcaatcaatgcatccacagggrattatttactggaaagtgtcaataagctgtttggtgagaagtctgcgagcttccgggaagaatatattcgactctgtcagaaatattactcctcagaacc

SEQ ID NO: 10851 - DNA, 201 bp, Homo sapiens
tcagggatgtcggagaggaatgacctgtttctttctgaagtgttccaccaagccatggtggatgtgaatgaggagggcactgaagcagccgctggcacagsaggtgttatgacagggagaactggacatggaggcccacagtttgtggcagatcatccttttctttttcttattatgcataagataaccaactgcatttta

SEQ ID NO: 10852 - DNA, 201 bp, Homo sapiens
cgagcttccgggaagaatatattcgactctgtcagaaatattactcctcagaaccccaggcagtagacttcctagaatgtgcagaagaagctagaaaaaarattaattcctgggtcaagactcaaaccaaaggcaaaatcccaaacttgttacctgaaggttctgtagatggggataccaggatggtcctggtgaatgctg

SEQ ID NO: 10853 - DNA, 201 bp, Homo sapiens
aatatattcgactctgtcagaaatattactcctcagaaccccaggcagtagacttcctagaatgtgcagaagaagctagaaaaaagattaattcctgggtsaagactcaaaccaaaggcaaaatcccaaacttgttacctgaaggttctgtagatggggataccaggatggtcctggtgaatgctgtctacttcaaaggaa

SEQ ID NO: 10854 - DNA, 201 bp, Homo sapiens
atggtcctggtgaatgctgtctacttcaaaggaaagtggaaaactccatttgagaagaaactaaatgggctttatcctttccgtgtaaactcggctcagcrcacacctgtacagatgatgtacttgcgtgaaaagctaaacattggatacatagaagacctaaaggctcagattctagaactcccatatgctggagatgtt

SEQ ID NO: 10855 - DNA, 201 bp, Homo sapiens; identical to SEQ ID NO: 10844

SEQ ID NO: 10856 - DNA, 201 bp, Homo sapiens; identical to SEQ ID NO: 10845

SEQ ID NO: 10857 - DNA, 201 bp, Homo sapiens; identical to SEQ ID NO: 10846

SEQ ID NO: 10858 - DNA, 201 bp, Homo sapiens; identical to SEQ ID NO: 10847

SEQ ID NO: 10859 - DNA, 201 bp, Homo sapiens; identical to SEQ ID NO: 10848

SEQ ID NO: 10860 - DNA, 129 bp, Homo sapiens
tgtaacaactctcagaggagcattgcccrtcagacagcaactcagagaataaccagagaacaaccagattgaaacaatggaggatctttgtgtggcaaacacactctttgccctcaatttattcaagca

SEQ ID NO: 10861 - DNA, 201 bp, Homo sapiens; identical to SEQ ID NO: 10849

SEQ ID NO: 10862 - DNA, 201 bp, Homo sapiens
gaagggtagttatcctgatgcgattttgcaggcacaagctgcagataaaatccattcatccttccgctctctcagctctgcaatcaatgcatccacagggrattatttactggaaagtgtcaataagctgtttggtgagaagtctgcgagcttccgggaagaatatattcgactctgtcagaaatattactcctcagaacc

SEQ ID NO: 10863 - DNA, 201 bp, Homo sapiens
ttaatgaagtgggagccaatgcagttacccccatgactccagagaactttaccagctgtgggttcatgcagcagatccagaagggtagttatcctgatgcvattttgcaggcacaagctgcagataaaatccattcatccttccgctctctcagctctgcaatcaatgcatccacagggaattatttactggaaagtgtca

SEQ ID NO: 10864 - DNA, 201 bp, Homo sapiens; identical to SEQ ID NO: 10851

SEQ ID NO: 10865 - DNA, 201 bp, Homo sapiens; identical to SEQ ID NO: 10852

SEQ ID NO: 10866 - DNA, 201 bp, Homo sapiens; identical to SEQ ID NO: 10853

SEQ ID NO: 10867 - DNA, 201 bp, Homo sapiens; identical to SEQ ID NO: 10854

SEQ ID NO: 10868 - DNA, 201 bp, Homo sapiens
ataggaccaattccagccataaagcaagctgttacaaaagcaggttggtcactggaagatgttgacatatttgaaatcaatgaagcctttgcagctgtctytgctgcaatagttaaagaacttggattaaacccagagaaggtcaatattgaaggaggggctatagccttgggccaccctcttggagcatctggctgtcga

SEQ ID NO: 10869 - DNA, 201 bp, Homo sapiens
tgaaatcagaggaccaaagtacagatggaaaccatttcctacatcacaaaaacccaagtttacagcttgtactttactttaatgtgtaatactcaactcamggtacaagacaattgcatttaacattgttataaataaaaggaacatcagatcaatcattaagggctccagagtgaacagcatcttcataacttccatgtt

SEQ ID NO: 10870 - DNA, 201 bp, Homo sapiens
tagaagccatgtccaagctaaagccttactttcttactgatggaacgggaacagtcaccccagccaatgcttcaggaataaatgatggtgctgcagctgtygttcttatgaagaagtcagaagctgataaacgtgggcttacacctttagcacggatagtttcctggtcccaagtgggtgtggagccttccattatgggaa

SEQ ID NO: 10871 - DNA, 201 bp, Homo sapiens
gaataggaccaattccagccataaagcaagctgttacaaaagcaggttggtcactggaagatgttgacatatttgaaatcaatgaagcctttgcagctgtytctgctgcaatagttaaagaacttggattaaacccagagaaggtcaatattgaaggaggggctatagccttgggccaccctcttggagcatctggctgtc

SEQ ID NO: 10872 - DNA, 201 bp, Homo sapiens
ccaagacgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacgtcccgcccgcggcaggcctgtgggctgcgaggaggagctttgcctagct

SEQ ID NO: 10873 - DNA, 201 bp, Homo sapiens
ctgatggaacgggaacagtcaccccagccaatgcttcaggaataaatgatggtgctgcagctgtcgttcttatgaagaagtcagaagctgataaacgtggrcttacacctttagcacggatagtttcctggtcccaagtgggtgtggagccttccattatgggaataggaccaattccagccataaagcaagctgttacaa

SEQ ID NO: 10874 - DNA, 201 bp, Homo sapiens
aatattgaaggaggggctatagccttgggccaccctcttggagcatctggctgtcgaattcttgtgaccctgttacacacactggagagaatgggcagaartcgtggtgttgcagccctgtgcattgggggtgggatgggaatagcaatgtgtgttcagagagaatgaattgcttaaactttgaacaacctcaatttcttt

SEQ ID NO: 10875 - DNA, 201 bp, Homo sapiens
cgtgggattccagtcctgagctgaacgagagataagtctttgtcaccccccagtctttactgtttcgagaaaccctaagattttttaaaaaaaagcccaaracgtcaagtcggggaactccaacattggggtgtccagaaacactggggtttcaggcgctctgtaaatgcgtccgaggtccgcggttctgcccgcaagccc

SEQ ID NO: 10876 - DNA, 201 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggcattttagatttttacgttctgggttaacctgggcctcat

SEQ ID NO: 10877 - DNA, 201 bp, Homo sapiens
caggacaaggttgcagttctgtcccagaacaggacagagaatgcacagaaagctggccattttgacaaagagattgtaccagttttggtgtcaactagaaraggtcttattgaagttaaaacagatgagtttcctcgccatgggagcaacatagaagccatgtccaagctaaagccttactttcttactgatggaacggga

SEQ ID NO: 10878 - DNA, 201 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggcattttagatttttacgttctgggttaacctgggcctca

SEQ ID NO: 10879 - DNA, 201 bp, Homo sapiens
tacagatggaaaccatttcctacatcacaaaaacccaagtttacagcttgtactttactttaatgtgtaatactcaactcaaggtacaagacaattgcatytaacattgttataaataaaaggaacatcagatcaatcattaagggctccagagtgaacagcatcttcataacttccatgtttatcatctttactttctgg

SEQ ID NO: 10880 - DNA, 201 bp, Homo sapiens
gcccctcacgcgagcgaatgactggcgccaggagaaacgcataggacctcccgaagccgccgagagcaaaaggacccatcagagctgtgctgagacccgcygcgggccgggctcgcactcgagattctcgcccgtgggattccagtcctgagctgaacgagagataagtctttgtcaccccccagtctttactgtttcgag

SEQ ID NO: 10881 - DNA, 201 bp, Homo sapiens; identical to SEQ ID NO: 10868

SEQ ID NO: 10882 - DNA, 201 bp, Homo sapiens; identical to SEQ ID NO: 10869

SEQ ID NO: 10883 - DNA, 201 bp, Homo sapiens; identical to SEQ ID NO: 10870

SEQ ID NO: 10884 - DNA, 201 bp, Homo sapiens; identical to SEQ ID NO: 10871

SEQ ID NO: 10885 - DNA, 201 bp, Homo sapiens; identical to SEQ ID NO: 10873

SEQ ID NO: 10886 - DNA, 201 bp, Homo sapiens; identical to SEQ ID NO: 10874

SEQ ID NO: 10887 - DNA, 193 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggatgtaatttaataagatcatcaattcgaagaa

SEQ ID NO: 10888 - DNA, 194 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggatgtaatttaataagatcatcaattcgaagaa

SEQ ID NO: 10889 - DNA, 201 bp, Homo sapiens; identical to SEQ ID NO: 10877

SEQ ID NO: 10890 - DNA, 201 bp, Homo sapiens; identical to SEQ ID NO: 10879

SEQ ID NO: 10891 - DNA, 201 bp, Homo sapiens
gtggagacgagaaaccaggaagaagaggctcgcttcccactcggcgaccgtaagcgaagcagccgaaggcgagcgccgacatcagcagctgccccctaaaycccgcccttcgtcttggcggcagcgggagactgagagacgcgcgcagcaggggcgggactggagaggggccccgcgcgcggatctcgcgagagcattaga

SEQ ID NO: 10892 - DNA, 201 bp, Homo sapiens
ccggagccgcagactccaaaagacagccctagcaagtcgagtgcggaggcgcagaccccagaagacacccccaacaagtcgggtgcggaggcaaagacccwaaaagacagctccaacaagtcgggtgcggaggcaaagacccaaaaaggcagcactagcaagtcgggttcggaggcgcagaccacaaaagacagcactagt

SEQ ID NO: 10893 - DNA, 201 bp, Homo sapiens
gtcgagtgcggaggcgcagaccccagaagacacccccaacaagtcgggtgcggaggcaaagacccaaaaagacagctccaacaagtcgggtgcggaggcamagacccaaaaaggcagcactagcaagtcgggttcggaggcgcagaccacaaaagacagcactagtaagtcgcatccggagctgcagactccaaaagacag

SEQ ID NO: 10894 - DNA, 201 bp, Homo sapiens
gcgtcaagcaagaagaagctggagtacggccttctgcaggaaacgtctccacccaccccagcttgagccaacggcctggaggctctaccaagtcgcatccsgagccgcagactccaaaagacagccctagcaagtcgagtgcggaggcgcagaccccagaagacacccccaacaagtcgggtgcggaggcaaagacccaaa

SEQ ID NO: 10895 - DNA, 201 bp, Homo sapiens
gcggaggcgcagaccccagaagacacccccaacaagtcgggtgcggaggcaaagacccaaaaagacagctccaacaagtcgggtgcggaggcaaagacccmaaaaggcagcactagcaagtcgggttcggaggcgcagaccacaaaagacagcactagtaagtcgcatccggagctgcagactccaaaagacagcactggc

SEQ ID NO: 10896 - DNA, 201 bp, Homo sapiens
cctgtaaggtctcggaagtacgaggcggaggggacgaaaaacggggggccagactgttgtggctgtggtggagacgagaaaccaggaagaagaggctcgcytcccactcggcgaccgtaagcgaagcagccgaaggcgagcgccgacatcagcagctgccccctaaatcccgcccttcgtcttggcggcagcgggagactg

SEQ ID NO: 10897 - DNA, 201 bp, Homo sapiens
aagtacgaggcggaggggacgaaaaacggggggccagactgttgtggctgtggtggagacgagaaaccaggaagaagaggctcgcttcccactcggcgacmgtaagcgaagcagccgaaggcgagcgccgacatcagcagctgccccctaaatcccgcccttcgtcttggcggcagcgggagactgagagacgcgcgcagc

SEQ ID NO: 10898 - DNA, 201 bp, Homo sapiens
cggaggcgcagaccccagaagacacccccaacaagtcgggtgcggaggcaaagacccaaaaagacagctccaacaagtcgggtgcggaggcaaagacccamaaaggcagcactagcaagtcgggttcggaggcgcagaccacaaaagacagcactagtaagtcgcatccggagctgcagactccaaaagacagcactggca

SEQ ID NO: 10899 - DNA, 201 bp, Homo sapiens
tgcagaggagcagggcccaatagacgggcccagcaagtcgggtgcggaggagcagacctcaaaagacagccctaacaaggtggttccagagcagccttccyggaaagaccattccaagcccatctccaacccttctgataacaaggagctccccaaggctgacacaaaccagcttgctgacaaagggaagctttctcctca

SEQ ID NO: 10900 - DNA, 201 bp, Homo sapiens
aagaggctgaagatgatgatacaggacccgaggagggctcaccgcccaaagaagagaaagaaaagatgtccggttctgcctccagtgagaaccgtgaaggracactttcggattccacgggtagcgagaaggatgacctttatccgaacggttctggaaatggcagcgcggagagcagccacttctttgcatatctggtga

SEQ ID NO: 10901 - DNA, 201 bp, Homo sapiens
aagaagaggctcgcttcccactcggcgaccgtaagcgaagcagccgaaggcgagcgccgacatcagcagctgccccctaaatcccgcccttcgtcttggckgcagcgggagactgagagacgcgcgcagcaggggcgggactggagaggggccccgcgcgcggatctcgcgagagcattagagggcggaagcgctatccga

SEQ ID NO: 10902 - DNA, 201 bp, Homo sapiens
cgctcttggccaccgaaagcgtcaagcaagaagaagctggagtacggccttctgcaggaaacgtctccacccaccccagcttgagccaacggcctggaggstctaccaagtcgcatccggagccgcagactccaaaagacagccctagcaagtcgagtgcggaggcgcagaccccagaagacacccccaacaagtcgggtg

SEQ ID NO: 10903 - DNA, 125 bp, Homo sapiens
agaggcgagggagctccagctctgmctgtaaggtctcggaagtacgaggcggaggggacgaaaaacggggggccagactgttgtggctgtggtggagacgagaaaccaggaagaagaggctcgct

SEQ ID NO: 10904 - DNA, 201 bp, Homo sapiens
gcgcagcaggggcgggactggagaggggccccgcgcgcggatctcgcgagagcattagagggcggaagcgctatccgagcaggatgcggttcgtggttgcmttggtcctcctgaacgtcgcagcggcgggagccgtgccgctcttggccaccgaaagcgtcaagcaagaagaagctggagtacggccttctgcaggaaacg

SEQ ID NO: 10905 - DNA, 201 bp, Homo sapiens
tctaccaagtcgcatccggagccgcagactccaaaagacagccctagcaagtcgagtgcggaggcgcagaccccagaagacacccccaacaagtcgggtgsggaggcaaagacccaaaaagacagctccaacaagtcgggtgcggaggcaaagacccaaaaaggcagcactagcaagtcgggttcggaggcgcagaccaca

SEQ ID NO: 10906 - DNA, 145 bp, Homo sapiens
agaggcgagggagctccagctctgcctgtaaggtctcggaagtamgaggcggaggggacgaaaaacggggggccagactgttgtggctgtggtggagacgagaaaccaggaagaagaggctcgcttcccactcggcgaccgtaag

SEQ ID NO: 10907 - DNA, 201 bp, Homo sapiens
ctttctcctcatgctttcaaaaccgaatctggggaggaaactgacctcatttctcccccgcaggaggaagttaagtcttcagagcctactgaggatgtggrgcccaaagaggctgaagatgatgatacaggacccgaggagggctcaccgcccaaagaagagaaagaaaagatgtccggttctgcctccagtgagaaccgt

SEQ ID NO: 10908 - DNA, 201 bp, Homo sapiens
gaaaaacggggggccagactgttgtggctgtggtggagacgagaaaccaggaagaagaggctcgcttcccactcggcgaccgtaagcgaagcagccgaagscgagcgccgacatcagcagctgccccctaaatcccgcccttcgtcttggcggcagcgggagactgagagacgcgcgcagcaggggcgggactggagaggg

SEQ ID NO: 10909 - DNA, 201 bp, Homo sapiens
ctagacacatctgtgcttcagtcatagatgttaatagaggaagcagttttcctgctgcagattcctgaatagagttgctgaaagagtctacttctggactyaggggaagttgaaggccagtctgtgtagaaaggctgaggcaacggggaaagacctgacagctagttacatacgctctgacatagtactcccatgatggct

SEQ ID NO: 10910 - DNA, 201 bp, Homo sapiens; identical to SEQ ID NO: 10891

SEQ ID NO: 10911 - DNA, 201 bp, Homo sapiens; identical to SEQ ID NO: 10892

SEQ ID NO: 10912 - DNA, 201 bp, Homo sapiens; identical to SEQ ID NO: 10893

SEQ ID NO: 10913 - DNA, 201 bp, Homo sapiens; identical to SEQ ID NO: 10895

SEQ ID NO: 10914 - DNA, 201 bp, Homo sapiens; identical to SEQ ID NO: 10896

SEQ ID NO: 10915 - DNA, 201 bp, Homo sapiens; identical to SEQ ID NO: 10897

SEQ ID NO: 10916 - DNA, 201 bp, Homo sapiens; identical to SEQ ID NO: 10898

SEQ ID NO: 10917 - DNA, 201 bp, Homo sapiens; identical to SEQ ID NO: 10899

SEQ ID NO: 10918 - DNA, 201 bp, Homo sapiens; identical to SEQ ID NO: 10900

SEQ ID NO: 10919 - DNA, 201 bp, Homo sapiens; identical to SEQ ID NO: 10901

SEQ ID NO: 10920 - DNA, 201 bp, Homo sapiens
ttattgcacacccccagcccattttgcttctctcttggattttgttttttcagatccacatttattgggtttcctgtccagcttcttggaaaggagctcamtcttggaaagactgatctttccaaaatattttccctggtctgaagctttggtctgaacttctcaaggcttagagaatccagttacagaccttttggggtt

SEQ ID NO: 10921 - DNA, 201 bp, Homo sapiens
atccacatttattgggtttcctgtccagcttcttggaaaggagctcaatcttggaaagactgatctttccaaaatattttccctggtctgaagctttggtstgaacttctcaaggcttagagaatccagttacagaccttttggggttcaggatgctatagattgacaccctcctgcctgtttttctctgcatcccaacct

SEQ ID NO: 10922 - DNA, 201 bp, Homo sapiens; identical to SEQ ID NO: 10902

SEQ ID NO: 10923 - DNA, 125 bp, Homo sapiens; identical to SEQ ID NO: 10903

SEQ ID NO: 10924 - DNA, 201 bp, Homo sapiens; identical to SEQ ID NO: 10904

SEQ ID NO: 10925 - DNA, 201 bp, Homo sapiens
ggatttggcgtgacttgcttgagcaagagtcctggggagagattttgaggtttaatttaacggtatatccagagctaacagtgactcaactcgtctagttmtgcaagtcagatgtacacttagagtctctctgtgaagggtttgggtctgagctgtatagtatgtcaaactgccagtaagccagcccctcaccctctgata

SEQ ID NO: 10926 - DNA, 201 bp, Homo sapiens
ctcacttcggtctctgtctgtcaactaaacttttctaaaggttaccagttatccaatcaccaaatccatggctttttctcaaagcttagtcttgtccttgrcagaactggacactattgaccatccaaatggaaattcccctttcttggtgtctctgacaaatggtcctttgccttatcttgtgctggtggtgaagaggcc

SEQ ID NO: 10927 - DNA, 201 bp, Homo sapiens
cattttgtcacggagtccacagagctgagcttttgagcagactctgagaagtatcattgcttgtgttgaaagaatacaacaggatttaagtttctctttaraaattgcactgaagaaaggccgggcgcggtggctccccctgtaatcccagcgctttgggaggccgaggcggggggatcacgaggtcaagagatcgagacc

SEQ ID NO: 10928 - DNA, 201 bp, Homo sapiens; identical to SEQ ID NO: 10908

SEQ ID NO: 10929 - DNA, 201 bp, Homo sapiens
tactttcagctttttgtaacttaactataattacttaattttatttttttaaagcttgttgtggtctaatgagaagtatttttcagtgcataatgtttttytgagcttctgtaaatgccatcccaatgtggtttggttttgttgaacagaaaccaaaataaatttcaaaatgttaaagcaatggatttaatacatttattt

SEQ ID NO: 10930 - DNA, 201 bp, Homo sapiens
tgagcaaaacagggcagtcaggatctgatgtctttctggtctccctaagaaaactaagctcttgagggacagcccttggcaatgctttcctatctgctgakcatggtgaccttccttaggacttccagagttcagttccttctggcagagaggttttctttctccatgccatatggatgtgactcaaatgaggggtcccac

SEQ ID NO: 10931 - DNA, 201 bp, Homo sapiens
ctttgggctttgcacctgcactttggtgacattgttcttctgtgttccctttatttatgctggtggcttccatccgttcctcctctgagggtgagtggagrggtatatggaaacacggctgtgaccaaagggagatcccagcctgggcaggctgcgctgctgaccaccctccctggggcccgggctctgtaggaaagttgg

SEQ ID NO: 10932 - DNA, 201 bp, Homo sapiens
ctttggtgacattgttcttctgtgttccctttatttatgctggtggcttccatccgttcctcctctgagggtgagtggagaggtatatggaaacacggctrtgaccaaagggagatcccagcctgggcaggctgcgctgctgaccaccctccctggggcccgggctctgtaggaaagttggtccttgactgtggcattgca

SEQ ID NO: 10933 - DNA, 201 bp, Homo sapiens
gtaatcccagcgctttgggaggccgaggcggggggatcacgaggtcaagagatcgagaccatcctggccaacatggtgaaaccccgtctctaataaaaatrcaaaaattagccgggcatggtgacgtgcacctgtagtcccagctactagataggctgaggcaggagaattgcttgaatccgggaggcggaggttgcagtg

SEQ ID NO: 10934 - DNA, 201 bp, Homo sapiens; identical to SEQ ID NO: 10894

SEQ ID NO: 10935 - DNA, 201 bp, Homo sapiens
agcattgaagaaaataccgcacatcagaggaaagcttattttctgcatggtgtcttttcaaagatagaatatttgaagcatgttttctagcgattgtgtgratgagggtgagctggctgaggcatcgctcaagctggggggtggtgtgtaagaagcacgtggagccacaagaggcacctcctatagtcagctaagggcttc

SEQ ID NO: 10936 - DNA, 201 bp, Homo sapiens
gtggtgtgtaagaagcacgtggagccacaagaggcacctcctatagtcagctaagggcttccctttctgcgcccagcttttgggtgaagggtgatttctaytagacacatctgtgcttcagtcatagatgttaatagaggaagcagttttcctgctgcagattcctgaatagagttgctgaaagagtctacttctggactc

SEQ ID NO: 10937 - DNA, 201 bp, Homo sapiens
ttaacggtatatccagagctaacagtgactcaactcgtctagttctgcaagtcagatgtacacttagagtctctctgtgaagggtttgggtctgagctgtrtagtatgtcaaactgccagtaagccagcccctcaccctctgatagatattcctttaatgcaccagacttcatgtttgataaatgattaatggttgaaatt

SEQ ID NO: 10938 - DNA, 201 bp, Homo sapiens
tgccatgtcaggagttaatacaaatgaagaaattccgtgggttcccctgggataagtgagggtagtgtcttggacaacactattgtttgaaggtttatctyttctaatcatgctctaccgcattgtagagagcctaaagagagttgtttctgagctgatctcagggaaatacaaataacttgggagatgagggaaataaga

SEQ ID NO: 10939 - DNA, 201 bp, Homo sapiens
agatctaaagtcacccggcggccaaaggccagtgactaccaacgtttggaccagaagtcctaacagaatggtatattcctctggaaaaagatgaacgtcaycaatggattgtgctgctctcgtttcagctttgatttttttgtccttgagaaccttgtcctccctgctgatttgtttctaaatcaaaagaaatgaagaaaa

SEQ ID NO: 10940 - DNA, 201 bp, Homo sapiens
cctctggaaaaagatgaacgtcaccaatggattgtgctgctctcgtttcagctttgatttttttgtccttgagaaccttgtcctccctgctgatttgtttytaaatcaaaagaaatgaagaaaaaagtactgtgacctgagagacaccctcctctagaatttagtggcgggtctgggctggcagaggtagggggctgcttt

SEQ ID NO: 10941 - DNA, 201 bp, Homo sapiens; identical to SEQ ID NO: 10905

SEQ ID NO: 10942 - DNA, 145 bp, Homo sapiens; identical to SEQ ID NO: 10906

SEQ ID NO: 10943 - DNA, 201 bp, Homo sapiens
ttatttatgctggtggcttccatccgttcctcctctgagggtgagtggagaggtatatggaaacacggctgtgaccaaagggagatcccagcctgggcagsctgcgctgctgaccaccctccctggggcccgggctctgtaggaaagttggtccttgactgtggcattgcactctgcactgtttctctctgcagacctagg

SEQ ID NO: 10944 - DNA, 201 bp, Homo sapiens
ggggatgtgccctacagaagacatagaagatggggaaatgccaatgggcaaagagctactttgaatacataattctcttcaaagacttcagcagcaaaccwaaacagcaggttaaaaaaaaagatgcttttttgggtgcaagtctaacctgtctagcatgagatcttcttgattttctgattattttatgtagcttgagac

SEQ ID NO: 10945 - DNA, 201 bp, Homo sapiens; identical to SEQ ID NO: 10907

SEQ ID NO: 10946 - DNA, 201 bp, Homo sapiens; identical to SEQ ID NO: 10909

SEQ ID NO: 10947 - DNA, 201 bp, Homo sapiens; identical to SEQ ID NO: 10891

SEQ ID NO: 10948 - DNA, 201 bp, Homo sapiens; identical to SEQ ID NO: 10892

SEQ ID NO: 10949 - DNA, 201 bp, Homo sapiens; identical to SEQ ID NO: 10893

SEQ ID NO: 10950 - DNA, 201 bp, Homo sapiens; identical to SEQ ID NO: 10895

SEQ ID NO: 10951 - DNA, 201 bp, Homo sapiens; identical to SEQ ID NO: 10896

SEQ ID NO: 10952 - DNA, 201 bp, Homo sapiens; identical to SEQ ID NO: 10897

SEQ ID NO: 10953 - DNA, 201 bp, Homo sapiens; identical to SEQ ID NO: 10898

SEQ ID NO: 10954 - DNA, 201 bp, Homo sapiens; identical to SEQ ID NO: 10899

SEQ ID NO: 10955 - DNA, 201 bp, Homo sapiens; identical to SEQ ID NO: 10900

SEQ ID NO: 10956 - DNA, 201 bp, Homo sapiens
taaagtcacccggcggccaaaggccagtgactaccaacgtttggaccagaagtatgtcttaattctgaatgttttccctgcacctcctaaaagatcttttytcccccaagtcctaacagaatggtatattcctctggaaaaagatgaacgtcaccaatggattgtgctgctctcgtttcagctttgatttttttgtccttg

SEQ ID NO: 10957 - DNA, 201 bp, Homo sapiens; identical to SEQ ID NO: 10901

SEQ ID NO: 10958 - DNA, 201 bp, Homo sapiens; identical to SEQ ID NO: 10920

SEQ ID NO: 10959 - DNA, 201 bp, Homo sapiens; identical to SEQ ID NO: 10921

SEQ ID NO: 10960 - DNA, 201 bp, Homo sapiens; identical to SEQ ID NO: 10902

SEQ ID NO: 10961 - DNA, 125 bp, Homo sapiens; identical to SEQ ID NO: 10903

SEQ ID NO: 10962 - DNA, 201 bp, Homo sapiens; identical to SEQ ID NO: 10904

SEQ ID NO: 10963 - DNA, 201 bp, Homo sapiens
aaacccctgttaggaaggttggatttggcgtgacttgcttgagcaagagtcctggggagagattttgaggtttaataacagtgactcaactcgtctagttmtgcaagtcagatgtacacttagagtctctctgtgaagggtttgggtctgagctgtatagtatgtcaaactgccagtaagccagcccctcaccctctgata

SEQ ID NO: 10964 - DNA, 201 bp, Homo sapiens; identical to SEQ ID NO: 10926

SEQ ID NO: 10965 - DNA, 201 bp, Homo sapiens; identical to SEQ ID NO: 10927

SEQ ID NO: 10966 - DNA, 201 bp, Homo sapiens; identical to SEQ ID NO: 10908

SEQ ID NO: 10967 - DNA, 201 bp, Homo sapiens; identical to SEQ ID NO: 10930

SEQ ID NO: 10968 - DNA, 201 bp, Homo sapiens; identical to SEQ ID NO: 10931

SEQ ID NO: 10969 - DNA, 201 bp, Homo sapiens; identical to SEQ ID NO: 10932

SEQ ID NO: 10970 - DNA, 201 bp, Homo sapiens; identical to SEQ ID NO: 10933

SEQ ID NO: 10971 - DNA, 201 bp, Homo sapiens; identical to SEQ ID NO: 10894

SEQ ID NO: 10972 - DNA, 201 bp, Homo sapiens; identical to SEQ ID NO: 10935

SEQ ID NO: 10973 - DNA, 201 bp, Homo sapiens; identical to SEQ ID NO: 10936

SEQ ID NO: 10974 - DNA, 178 bp, Homo sapiens
gagagattttgaggtttaataacagtgactcaactcgtctagttctgcaagtcagatgtacacttagagtctctctgtgaagggtttgggtctgagctgtrtagtatgtcaaactgccagtaagccagcccctcaccctctgatagatattcctttaatgcaccagacttcatgtttg

SEQ ID NO: 10975 - DNA, 201 bp, Homo sapiens; identical to SEQ ID NO: 10938

SEQ ID NO: 10976 - DNA, 201 bp, Homo sapiens
atgtcttaattctgaatgttttccctgcacctcctaaaagatcttttttcccccaagtcctaacagaatggtatattcctctggaaaaagatgaacgtcaycaatggattgtgctgctctcgtttcagctttgatttttttgtccttgagaaccttgtcctccctgctgatttgtttctaaatcaaaagaaatgaagaaaa

SEQ ID NO: 10977 - DNA, 201 bp, Homo sapiens; identical to SEQ ID NO: 10940

SEQ ID NO: 10978 - DNA, 201 bp, Homo sapiens; identical to SEQ ID NO: 10905

SEQ ID NO: 10979 - DNA, 145 bp, Homo sapiens; identical to SEQ ID NO: 10906

SEQ ID NO: 10980 - DNA, 201 bp, Homo sapiens; identical to SEQ ID NO: 10943

SEQ ID NO: 10981 - DNA, 201 bp, Homo sapiens; identical to SEQ ID NO: 10944

SEQ ID NO: 10982 - DNA, 201 bp, Homo sapiens; identical to SEQ ID NO: 10907

SEQ ID NO: 10983 - DNA, 201 bp, Homo sapiens
cacccggcggccaaaggccagtgactaccaacgtttggaccagaagtatgtcttaattctgaatgttttccctgcacctcctaaaagatcttttttccccyaagtcctaacagaatggtatattcctctggaaaaagatgaacgtcaccaatggattgtgctgctctcgtttcagctttgatttttttgtccttgagaacc

SEQ ID NO: 10984 - DNA, 201 bp, Homo sapiens; identical to SEQ ID NO: 10909

SEQ ID NO: 10985 - DNA, 201 bp, Homo sapiens; identical to SEQ ID NO: 10891

SEQ ID NO: 10986 - DNA, 201 bp, Homo sapiens; identical to SEQ ID NO: 10892

SEQ ID NO: 10987 - DNA, 201 bp, Homo sapiens; identical to SEQ ID NO: 10893

SEQ ID NO: 10988 - DNA, 201 bp, Homo sapiens; identical to SEQ ID NO: 10895

SEQ ID NO: 10989 - DNA, 201 bp, Homo sapiens; identical to SEQ ID NO: 10896

SEQ ID NO: 10990 - DNA, 201 bp, Homo sapiens; identical to SEQ ID NO: 10897

SEQ ID NO: 10991 - DNA, 201 bp, Homo sapiens; identical to SEQ ID NO: 10898

SEQ ID NO: 10992 - DNA, 201 bp, Homo sapiens; identical to SEQ ID NO: 10899

SEQ ID NO: 10993 - DNA, 201 bp, Homo sapiens; identical to SEQ ID NO: 10900

SEQ ID NO: 10994 - DNA, 201 bp, Homo sapiens
aagcggaagatcattgcttttgtcctggaaggaaaaagatctaaagtcacccggcggccaaaggccagtgactaccaacgtttggaccagaagatcttttytcccccaagtcctaacagaatggtatattcctctggaaaaagatgaacgtcaccaatggattgtgctgctctcgtttcagctttgatttttttgtccttg

SEQ ID NO: 10995 - DNA, 201 bp, Homo sapiens; identical to SEQ ID NO: 10901

SEQ ID NO: 10996 - DNA, 201 bp, Homo sapiens; identical to SEQ ID NO: 10920

SEQ ID NO: 10997 - DNA, 201 bp, Homo sapiens; identical to SEQ ID NO: 10921

SEQ ID NO: 10998 - DNA, 201 bp, Homo sapiens; identical to SEQ ID NO: 10902

SEQ ID NO: 10999 - DNA, 125 bp, Homo sapiens; identical to SEQ ID NO: 10903

SEQ ID NO: 11000 - DNA, 201 bp, Homo sapiens; identical to SEQ ID NO: 10904

SEQ ID NO: 11001 - DNA, 201 bp, Homo sapiens; identical to SEQ ID NO: 10963

SEQ ID NO: 11002 - DNA, 201 bp, Homo sapiens; identical to SEQ ID NO: 10926

SEQ ID NO: 11003 - DNA, 201 bp, Homo sapiens; identical to SEQ ID NO: 10927

SEQ ID NO: 11004 - DNA, 201 bp, Homo sapiens; identical to SEQ ID NO: 10908

SEQ ID NO: 11005 - DNA, 201 bp, Homo sapiens; identical to SEQ ID NO: 10930

SEQ ID NO: 11006 - DNA, 201 bp, Homo sapiens; identical to SEQ ID NO: 10931

SEQ ID NO: 11007 - DNA, 201 bp, Homo sapiens; identical to SEQ ID NO: 10932

SEQ ID NO: 11008 - DNA, 201 bp, Homo sapiens; identical to SEQ ID NO: 10933

SEQ ID NO: 11009 - DNA, 201 bp, Homo sapiens; identical to SEQ ID NO: 10894

SEQ ID NO: 11010 - DNA, 201 bp, Homo sapiens; identical to SEQ ID NO: 10935

SEQ ID NO: 11011 - DNA, 201 bp, Homo sapiens; identical to SEQ ID NO: 10936

SEQ ID NO: 11012 - DNA, 178 bp, Homo sapiens; identical to SEQ ID NO: 10974

SEQ ID NO: 11013 - DNA, 201 bp, Homo sapiens; identical to SEQ ID NO: 10938

SEQ ID NO: 11014 - DNA, 201 bp, Homo sapiens
gcggccaaaggccagtgactaccaacgtttggaccagaagatcttttttcccccaagtcctaacagaatggtatattcctctggaaaaagatgaacgtcaycaatggattgtgctgctctcgtttcagctttgatttttttgtccttgagaaccttgtcctccctgctgatttgtttctaaatcaaaagaaatgaagaaaa

SEQ ID NO: 11015 - DNA, 201 bp, Homo sapiens; identical to SEQ ID NO: 10940

SEQ ID NO: 11016 - DNA, 201 bp, Homo sapiens; identical to SEQ ID NO: 10905

SEQ ID NO: 11017 - DNA, 145 bp, Homo sapiens; identical to SEQ ID NO: 10906

SEQ ID NO: 11018 - DNA, 201 bp, Homo sapiens; identical to SEQ ID NO: 10943

SEQ ID NO: 11019 - DNA, 201 bp, Homo sapiens; identical to SEQ ID NO: 10944

SEQ ID NO: 11020 - DNA, 201 bp, Homo sapiens; identical to SEQ ID NO: 10907

SEQ ID NO: 11021 - DNA, 201 bp, Homo sapiens
aagatcattgcttttgtcctggaaggaaaaagatctaaagtcacccggcggccaaaggccagtgactaccaacgtttggaccagaagatcttttttccccyaagtcctaacagaatggtatattcctctggaaaaagatgaacgtcaccaatggattgtgctgctctcgtttcagctttgatttttttgtccttgagaacc

SEQ ID NO: 11022 - DNA, 201 bp, Homo sapiens; identical to SEQ ID NO: 10909

SEQ ID NO: 11023 - DNA, 201 bp, Homo sapiens; identical to SEQ ID NO: 10891

SEQ ID NO: 11024 - DNA, 201 bp, Homo sapiens; identical to SEQ ID NO: 10892

SEQ ID NO: 11025 - DNA, 201 bp, Homo sapiens; identical to SEQ ID NO: 10893

SEQ ID NO: 11026 - DNA, 201 bp, Homo sapiens; identical to SEQ ID NO: 10895

SEQ ID NO: 11027 - DNA, 201 bp, Homo sapiens; identical to SEQ ID NO: 10896

SEQ ID NO: 11028 - DNA, 201 bp, Homo sapiens; identical to SEQ ID NO: 10897

SEQ ID NO: 11029 - DNA, 201 bp, Homo sapiens; identical to SEQ ID NO: 10898

SEQ ID NO: 11030 - DNA, 201 bp, Homo sapiens; identical to SEQ ID NO: 10899

SEQ ID NO: 11031 - DNA, 201 bp, Homo sapiens; identical to SEQ ID NO: 10900

SEQ ID NO: 11032 - DNA, 201 bp, Homo sapiens; identical to SEQ ID NO: 10956

SEQ ID NO: 11033 - DNA, 201 bp, Homo sapiens; identical to SEQ ID NO: 10901

SEQ ID NO: 11034 - DNA, 201 bp, Homo sapiens; identical to SEQ ID NO: 10920

SEQ ID NO: 11035 - DNA, 201 bp, Homo sapiens; identical to SEQ ID NO: 10921

SEQ ID NO: 11036 - DNA, 201 bp, Homo sapiens; identical to SEQ ID NO: 10902

SEQ ID NO: 11037 - DNA, 125 bp, Homo sapiens; identical to SEQ ID NO: 10903

SEQ ID NO: 11038 - DNA, 201 bp, Homo sapiens; identical to SEQ ID NO: 10904

SEQ ID NO: 11039 - DNA, 201 bp, Homo sapiens; identical to SEQ ID NO: 10925

SEQ ID NO: 11040 - DNA, 201 bp, Homo sapiens; identical to SEQ ID NO: 10926

SEQ ID NO: 11041 - DNA, 201 bp, Homo sapiens; identical to SEQ ID NO: 10927

SEQ ID NO: 11042 - DNA, 201 bp, Homo sapiens; identical to SEQ ID NO: 10908

SEQ ID NO: 11043 - DNA, 201 bp, Homo sapiens; identical to SEQ ID NO: 10929

SEQ ID NO: 11044 - DNA, 201 bp, Homo sapiens; identical to SEQ ID NO: 10930

SEQ ID NO: 11045 - DNA, 201 bp, Homo sapiens; identical to SEQ ID NO: 10931

SEQ ID NO: 11046 - DNA, 201 bp, Homo sapiens; identical to SEQ ID NO: 10932

SEQ ID NO: 11047 - DNA, 201 bp, Homo sapiens; identical to SEQ ID NO: 10933

SEQ ID NO: 11048 - DNA, 201 bp, Homo sapiens; identical to SEQ ID NO: 10894

SEQ ID NO: 11049 - DNA, 201 bp, Homo sapiens; identical to SEQ ID NO: 10935

SEQ ID NO: 11050 - DNA, 201 bp, Homo sapiens; identical to SEQ ID NO: 10936

SEQ ID NO: 11051 - DNA, 201 bp, Homo sapiens; identical to SEQ ID NO: 10937

SEQ ID NO: 11052 - DNA, 201 bp, Homo sapiens; identical to SEQ ID NO: 10938

SEQ ID NO: 11053 - DNA, 201 bp, Homo sapiens; identical to SEQ ID NO: 10976

SEQ ID NO: 11054 - DNA, 201 bp, Homo sapiens; identical to SEQ ID NO: 10940

SEQ ID NO: 11055 - DNA, 201 bp, Homo sapiens; identical to SEQ ID NO: 10905

SEQ ID NO: 11056 - DNA, 145 bp, Homo sapiens; identical to SEQ ID NO: 10906

SEQ ID NO: 11057 - DNA, 201 bp, Homo sapiens; identical to SEQ ID NO: 10943

SEQ ID NO: 11058 - DNA, 201 bp, Homo sapiens; identical to SEQ ID NO: 10944

SEQ ID NO: 11059 - DNA, 201 bp, Homo sapiens; identical to SEQ ID NO: 10907

SEQ ID NO: 11060 - DNA, 201 bp, Homo sapiens; identical to SEQ ID NO: 10983

SEQ ID NO: 11061 - DNA, 201 bp, Homo sapiens
cgtctgctgctcaagacccacaggacgccgggaagactaaatgatcactgcccccagtgaatatggtgaagaagctggtgatggcccagaagcggggagaracacgagccctttgcctgggtgtaaccatggtggtgtgtgccgtcatcacctactacatcctggtcacgactgtgctgcccctctaccagaaaagcgtgt

SEQ ID NO: 11062 - DNA, 201 bp, Homo sapiens
ctacatcctggtcacgactgtgctgcccctctaccagaaaagcgtgtggacccaggaatccaagtgccacctgattgagaccaacatcagggaccaggagragctgaagggcaagaaggtgccccagtacccatgcctgtgggtcaacgtgtcagctgccggcaggtgggctgtgctgtaccacacggaggacactcggga

SEQ ID NO: 11063 - DNA, 201 bp, Homo sapiens
gaggccaaacttcctgctgaagctctgtggcctcttttggggtgggggcgggggtccaggcagaaagaaaccgtctgctgctcaagacccacaggacgccsggaagactaaatgatcactgcccccagtgaatatggtgaagaagctggtgatggcccagaagcggggagagacacgagccctttgcctgggtgtaaccat

SEQ ID NO: 11064 - DNA, 186 bp, Homo sapiens
agcccacagagacagagagaagaagaaatatttccaaatataccaggctgatctttcgtagtttctcagtcttgctgtctgttgtygtttgaaatctgtttcccacgagactctgggaagatggaggtgcagggcttgggtaacagctgccttcctcagggctgggtacctgctctccgagtctgt

SEQ ID NO: 11065 - DNA, 201 bp, Homo sapiens
ccgagtctgtgtctccaggctgtgtgctcagacttgaccatgtttgggcatggaggcttgccccagatggggaccaaaagctgcttccctggagacgggcrgggaggccaaacttcctgctgaagctctgtggcctcttttggggtgggggcgggggtccaggcagaaagaaaccgtctgctgctcaagacccacaggacg

SEQ ID NO: 11066 - DNA, 201 bp, Homo sapiens
tccctggagacgggcggggaggccaaacttcctgctgaagctctgtggcctcttttggggtgggggcgggggtccaggcagaaagaaaccgtctgctgctmaagacccacaggacgccgggaagactaaatgatcactgcccccagtgaatatggtgaagaagctggtgatggcccagaagcggggagagacacgagccct

SEQ ID NO: 11067 - DNA, 201 bp, Homo sapiens
caaaagctgcttccctggagacgggcggggaggccaaacttcctgctgaagctctgtggcctcttttggggtgggggcgggggtccaggcagaaagaaacygtctgctgctcaagacccacaggacgccgggaagactaaatgatcactgcccccagtgaatatggtgaagaagctggtgatggcccagaagcggggagag

SEQ ID NO: 11068 - DNA, 201 bp, Homo sapiens
agaaagagtgagaaatttgccaaaaattctacagccaatccaagcagagccaggactccaaggtaggacctgcgcccagtgctcctacatcccaggcagcstggacaattaccagacggcccgggccgacgtggagaaggtcagagccaaattccaagagcagcaggtcttctactgcttctccgcacctcgggggaacga

SEQ ID NO: 11069 - DNA, 191 bp, Homo sapiens
atgaagcttcagggctcagaaagagtgagaaatttgccaaaaattctacagccaatccaagcagagccaggactccaaggtaggacctgcrcccagtgctcctacatcccaggcagcgtggacaattaccagacggcccgggccgacgtggagaaggtcagagccaaattccaagagcagcaggtcttcta

SEQ ID NO: 11070 - DNA, 201 bp, Homo sapiens; identical to SEQ ID NO: 11062

SEQ ID NO: 11071 - DNA, 201 bp, Homo sapiens
cctgtgggtcaacgtgtcagctgccggcaggtgggctgtgctgtaccacacggaggacactcgggaccagaaccagcagtgctcctacatcccaggcagcstggacaattaccagacggcccgggccgacgtggagaaggtcagagccaaattccaagagcagcaggtcttctactgcttctccgcacctcgggggaacga

SEQ ID NO: 11072 - DNA, 201 bp, Homo sapiens; identical to SEQ ID NO: 11063

SEQ ID NO: 11073 - DNA, 186 bp, Homo sapiens; identical to SEQ ID NO: 11064

SEQ ID NO: 11074 - DNA, 201 bp, Homo sapiens
catcctggcggcccagaagtagagccatccatccatgccataccacttgtcagggcacaggggactggctgggcccccagggctgctccccacttgcagcmcaatgccttctccacctgccctcccactcttccagtccaatccacgctgtcttctgttgcaggactaacctttgagaaatccttttgtgaagtcattgcc

SEQ ID NO: 11075 - DNA, 128 bp, Homo sapiens
taaagtgccatatatatttttaattccaatattaataaatgtatgccaaacaacaatcagctgcaaggaaacacatgagaactcatcaaaattttagcggygggatggtggttaatttctgttttctt

SEQ ID NO: 11076 - DNA, 201 bp, Homo sapiens
ccatcctggcggcccagaagtagagccatccatccatgccataccacttgtcagggcacaggggactggctgggcccccagggctgctccccacttgcagmacaatgccttctccacctgccctcccactcttccagtccaatccacgctgtcttctgttgcaggactaacctttgagaaatccttttgtgaagtcattgc

SEQ ID NO: 11077 - DNA, 201 bp, Homo sapiens; identical to SEQ ID NO: 11066

SEQ ID NO: 11078 - DNA, 201 bp, Homo sapiens; identical to SEQ ID NO: 11067

SEQ ID NO: 11079 - DNA, 201 bp, Homo sapiens; identical to SEQ ID NO: 11061

SEQ ID NO: 11080 - DNA, 201 bp, Homo sapiens
ctgctcaagaatgtacagtggctccccaatgccttggaggccataaggccagccagttctagctctctattacctgtccccactcaactgactcatacctktttccggctgcatcactatgtgccccacagagaacgatgatcgtcacctctgtgcctgagttctccctgttgtctcaaagcggtacccatcctcccccag

SEQ ID NO: 11081 - DNA, 201 bp, Homo sapiens
tcaagaatgtacagtggctccccaatgccttggaggccataaggccagccagttctagctctctattacctgtccccactcaactgactcatacctgtttycggctgcatcactatgtgccccacagagaacgatgatcgtcacctctgtgcctgagttctccctgttgtctcaaagcggtacccatcctcccccagaagc

SEQ ID NO: 11082 - DNA, 201 bp, Homo sapiens
tggctccccaatgccttggaggccataaggccagccagttctagctctctattacctgtccccactcaactgactcatacctgtttccggctgcatcactrtgtgccccacagagaacgatgatcgtcacctctgtgcctgagttctccctgttgtctcaaagcggtacccatcctcccccagaagctgtccccagcgagc

SEQ ID NO: 11083 - DNA, 201 bp, Homo sapiens; identical to SEQ ID NO: 11065

SEQ ID NO: 11084 - DNA, 201 bp, Homo sapiens
catttcaaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaaggaagaaaggagctaccttaccccagcatatacctgcgggatgttctct

SEQ ID NO: 11085 - DNA, 201 bp, Homo sapiens
aatattttaggataattgcctacagagggatttatttttatgatgctggaaatatgaaatgtattttaaaatttcactctggcatatgatttatctatcamcattacttttttttaagtcacaatttcagaattttgggacatttgcattcaatttacaggtaccagtacgtacatattttaatagaaagatacaaccttt

SEQ ID NO: 11086 - DNA, 201 bp, Homo sapiens
tctggccagccctcagaaagcattttaggtcaagcagaggacaagaggagataagtggcgcactcccggtggcatcacctgcatcctcgaggacagacctygtgaagtcagagctgctacacattgaatctcaagtcgagcttctgagattcgatgattcaggaagaaaggattctgaggttttgaagcaaaatgcagtga

SEQ ID NO: 11087 - DNA, 201 bp, Homo sapiens
actccaagaacaacacccagatggaaattttggagcaatgtggttgttttttggctgcaggcataaggatagggattatctattcagaaaagagctcagayatttccttaagcatgggatcttaactcatctaaaggtttccttctcaagagatgctcctgttggggaggaggaagccccagcaaagtatgtgcaagacaa

SEQ ID NO: 11088 - DNA, 201 bp, Homo sapiens
tggattgctggactctggccagccctcagaaagcattttaggtcaagcagaggacaagaggagataagtggcgcactcccggtggcatcacctgcatcctygaggacagaccttgtgaagtcagagctgctacacattgaatctcaagtcgagcttctgagattcgatgattcaggaagaaaggattctgaggttttgaag

SEQ ID NO: 11089 - DNA, 201 bp, Homo sapiens
ctttgagtcctcacttacccgttcggtacccccactctcacaagcctctctgaatattcctggtttacccccagaatatttacaggtacatctgcaggagwctcttggccaggaggaaagccaagtatctgtgacttcagcagatccagtttttcaagtgccaatttcaaaggcagttcaacttactacgaatgatgccat

SEQ ID NO: 11090 - DNA, 201 bp, Homo sapiens
gagacccacccgacacagcccgcaagtttgttaaggaaatacagaaccaaacactgccggttgatttctttgctcacctgcggtatgggttactgggtctyggtgattcagaatacacctacttttgcaatggggggaagataattgataaacgacttcaagagcttggagcccggcatttctatgacactggacatgcag

SEQ ID NO: 11091 - DNA, 201 bp, Homo sapiens
tctcggtgattcagaatacacctacttttgcaatggggggaagataattgataaacgacttcaagagcttggagcccggcatttctatgacactggacatrcagatgactgtgtaggtttagaacttgtggttgagccgtggattgctggactctggccagccctcagaaagcattttaggtcaagcagaggacaagagga

SEQ ID NO: 11092 - DNA, 108 bp, Homo sapiens
atatatattgtatttttatttgatagcttgggatttaaaacatctctgttgaaggcttttgatccttttgagaaataaagatctgaaagaaatggcataaycttaaaa

SEQ ID NO: 11093 - DNA, 201 bp, Homo sapiens
actgccggttgatttctttgctcacctgcggtatgggttactgggtctcggtgattcagaatacacctacttttgcaatggggggaagataattgataaaygacttcaagagcttggagcccggcatttctatgacactggacatgcagatgactgtgtaggtttagaacttgtggttgagccgtggattgctggactctg

SEQ ID NO: 11094 - DNA, 201 bp, Homo sapiens
ctggtgtcttgaaatccgagcaattcctaaaaaggcatttttgcgagcccttgtggactataccagtgacagtgctgaaaagcgcaggctacaggagctgygcagtaaacaaggggcagccgattatagccgctttgtacgagatgcctgtgcctgcttgttggatctcctcctcgctttcccttcttgccagccaccact

SEQ ID NO: 11095 - DNA, 201 bp, Homo sapiens
ttcgtgtgcaagctcaagtttatttcacccaggaaagctccattttgtcttcaacattgtggaatttctgtctactgccacaacagaggttctgcggaagrgagtatgtacaggctggctggccttgttggttgcttcagttcttcagccaaacatacatgcatcccatgaagacagcgggaaagccctggctcctaagat

SEQ ID NO: 11096 - DNA, 201 bp, Homo sapiens
agctcattcttgtgacttacagtgccaacatttaaaaaagtatgaaaatgatttatttttatatgatgtatacccataaagaatgctcatattaatgtacytaaattacacatgtagagcatatctgttatatgtttatgtaactatcaaatggttatttgttactaaagctatatttctgataaaaaatattttaggata

SEQ ID NO: 11097 - DNA, 119 bp, Homo sapiens
ggagctttctattggtccygggtaccgagcatgggcgctgcgtcagtgcgcgctggcgcaaggttggtggaagtcgcgttgtgcagtttcactgttacatgccttgaagtgatgaggag

SEQ ID NO: 11098 - DNA, 201 bp, Homo sapiens
attgcctacagagggatttatttttatgatgctggaaatatgaaatgtattttaaaatttcactctggcatatgatttatctatcaccattactttttttwaagtcacaatttcagaattttgggacatttgcattcaatttacaggtaccagtacgtacatattttaatagaaagatacaacctttttattttcactcct

SEQ ID NO: 11099 - DNA, 201 bp, Homo sapiens
gaatgctcatattaatgtacttaaattacacatgtagagcatatctgttatatgtttatgtaactatcaaatggttatttgttactaaagctatatttctrataaaaaatattttaggataattgcctacagagggatttatttttatgatgctggaaatatgaaatgtattttaaaatttcactctggcatatgatttat

SEQ ID NO: 11100 - DNA, 201 bp, Homo sapiens
caaaggcttcctgaaatagggagactgactgagtagctcattcttgtgacttacagtgccaacatttaaaaaagtatgaaaatgatttatttttatatgaygtatacccataaagaatgctcatattaatgtacttaaattacacatgtagagcatatctgttatatgtttatgtaactatcaaatggttatttgttacta

SEQ ID NO: 11101 - DNA, 201 bp, Homo sapiens
aaggagctaccttaccccagcatatacctgcgggatgttctctccagttcatttttacctggtgtcttgaaatccgagcaattcctaaaaaggcatttttrcgagcccttgtggactataccagtgacagtgctgaaaagcgcaggctacaggagctgtgcagtaaacaaggggcagccgattatagccgctttgtacgag

SEQ ID NO: 11102 - DNA, 201 bp, Homo sapiens
aaaggcatttttgcgagcccttgtggactataccagtgacagtgctgaaaagcgcaggctacaggagctgtgcagtaaacaaggggcagccgattatagcygctttgtacgagatgcctgtgcctgcttgttggatctcctcctcgctttcccttcttgccagccaccactcagtctcctgctcgaacatcttcctaaact

SEQ ID NO: 11103 - DNA, 201 bp, Homo sapiens
atctaaaggtttccttctcaagagatgctcctgttggggaggaggaagccccagcaaagtatgtgcaagacaacatccagcttcatggccagcaggtggcragaatcctcctccaggagaacggccatatttatgtgtgtggagatgcaaagaatatggccaaggatgtacatgatgcccttgtgcaaataataagcaaag

SEQ ID NO: 11104 - DNA, 201 bp, Homo sapiens
agctcagacatttccttaagcatgggatcttaactcatctaaaggtttccttctcaagagatgctcctgttggggaggaggaagccccagcaaagtatgtrcaagacaacatccagcttcatggccagcaggtggcgagaatcctcctccaggagaacggccatatttatgtgtgtggagatgcaaagaatatggccaagg

SEQ ID NO: 11105 - DNA, 201 bp, Homo sapiens
tgccctaacagtgattctgaggtacaaagcctactccaaagactgcagcttgaagataaaagagagcactgcgtccttttgaaaataaaggcagacacaargaagaaaggagctaccttaccccagcatatacctgcgggatgttctctccagttcatttttacctggtgtcttgaaatccgagcaattcctaaaaaggca

SEQ ID NO: 11106 - DNA, 201 bp, Homo sapiens
ggttcctacaacatagagagaaactccaagaacaacacccagatggaaattttggagcaatgtggttgttttttggctgcaggcataaggatagggattayctattcagaaaagagctcagacatttccttaagcatgggatcttaactcatctaaaggtttccttctcaagagatgctcctgttggggaggaggaagccc

SEQ ID NO: 11107 - DNA, 201 bp, Homo sapiens
acagtgccaacatttaaaaaagtatgaaaatgatttatttttatatgatgtatacccataaagaatgctcatattaatgtacttaaattacacatgtagakcatatctgttatatgtttatgtaactatcaaatggttatttgttactaaagctatatttctgataaaaaatattttaggataattgcctacagagggatt

SEQ ID NO: 11108 - DNA, 201 bp, Homo sapiens
ttggtcataaaaccagaaattaaagaaagaggattaagcttttttgactgaaagtactaaaagtcagctttactagtgccaaacctttaaattttcaaaakaaaattttctttcaacatttcttgaaggacatggagtggagattggatcatttaacaatataacaaaacttcctgatttgattttacgtatcttctatct

SEQ ID NO: 11109 - DNA, 201 bp, Homo sapiens
aaaaaatattttaggataattgcctacagagggatttatttttatgatgctggaaatatgaaatgtattttaaaatttcactctggcatatgatttatctrtcaccattacttttttttaagtcacaatttcagaattttgggacatttgcattcaatttacaggtaccagtacgtacatattttaatagaaagatacaac

SEQ ID NO: 11110 - DNA, 201 bp, Homo sapiens
atccatctctcctcgaacaacaaattctttccacttaccagatgacccctcaatccccatcataatggtgggtccaggaaccggcatagccccgtttattrggttcctacaacatagagagaaactccaagaacaacacccagatggaaattttggagcaatgtggttgttttttggctgcaggcataaggatagggatta

SEQ ID NO: 11111 - DNA, 201 bp, Homo sapiens
gcctcctttacttcccagagaacttcacagagactctgtccttccatgcaaaggcttcctgaaatagggagactgactgagtagctcattcttgtgacttrcagtgccaacatttaaaaaagtatgaaaatgatttatttttatatgatgtatacccataaagaatgctcatattaatgtacttaaattacacatgtagag

SEQ ID NO: 11112 - DNA, 201 bp, Homo sapiens
aagtcagctttactagtgccaaacctttaaattttcaaaagaaaattttctttcaacatttcttgaaggacatggagtggagattggatcatttaacaatrtaacaaaacttcctgatttgattttacgtatcttctatctacgcccttcctgtgcctgtgactctccccaaattgccctgttgccttgagctcttctgag

SEQ ID NO: 11113 - DNA, 201 bp, Homo sapiens
cgttgtgcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataagtatgacctaaaaaccgaaacagctcctcttgttgttg

SEQ ID NO: 11114 - DNA, 201 bp, Homo sapiens
agaagaaaaacgctaccttcaggatatttggtcataaaaccagaaattaaagaaagaggattaagcttttttgactgaaagtactaaaagtcagctttacyagtgccaaacctttaaattttcaaaagaaaattttctttcaacatttcttgaaggacatggagtggagattggatcatttaacaatataacaaaacttcc

SEQ ID NO: 11115 - DNA, 201 bp, Homo sapiens
ttaagcatgggatcttaactcatctaaaggtttccttctcaagagatgctcctgttggggaggaggaagccccagcaaagtatgtgcaagacaacatccarcttcatggccagcaggtggcgagaatcctcctccaggagaacggccatatttatgtgtgtggagatgcaaagaatatggccaaggatgtacatgatgccc

SEQ ID NO: 11116 - DNA, 201 bp, Homo sapiens
cctggccactttaaaagaagaaaaacgctaccttcaggatatttggtcataaaaccagaaattaaagaaagaggattaagcttttttgactgaaagtactraaagtcagctttactagtgccaaacctttaaattttcaaaagaaaattttctttcaacatttcttgaaggacatggagtggagattggatcatttaacaa

SEQ ID NO: 11117 - DNA, 201 bp, Homo sapiens
tttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaaca

SEQ ID NO: 11118 - DNA, 201 bp, Homo sapiens
gtgcaagctcaagtttatttcacccaggaaagctccattttgtcttcaacattgtggaatttctgtctactgccacaacagaggttctgcggaagggagtrtgtacaggctggctggccttgttggttgcttcagttcttcagccaaacatacatgcatcccatgaagacagcgggaaagccctggctcctaagatatcca

SEQ ID NO: 11119 - DNA, 201 bp, Homo sapiens
ccacaacagaggttctgcggaagggagtatgtacaggctggctggccttgttggttgcttcagttcttcagccaaacatacatgcatcccatgaagacagygggaaagccctggctcctaagatatccatctctcctcgaacaacaaattctttccacttaccagatgacccctcaatccccatcataatggtgggtccag

SEQ ID NO: 11120 - DNA, 201 bp, Homo sapiens
tggtggaagtcgcgttgtgcagtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataagtatgacctaaaaaccgaaacagctc

SEQ ID NO: 11121 - DNA, 201 bp, Homo sapiens; identical to SEQ ID NO: 11084

SEQ ID NO: 11122 - DNA, 201 bp, Homo sapiens; identical to SEQ ID NO: 11085

SEQ ID NO: 11123 - DNA, 201 bp, Homo sapiens; identical to SEQ ID NO: 11086

SEQ ID NO: 11124 - DNA, 201 bp, Homo sapiens; identical to SEQ ID NO: 11087

SEQ ID NO: 11125 - DNA, 201 bp, Homo sapiens; identical to SEQ ID NO: 11088

SEQ ID NO: 11126 - DNA, 201 bp, Homo sapiens; identical to SEQ ID NO: 11089

SEQ ID NO: 11127 - DNA, 201 bp, Homo sapiens; identical to SEQ ID NO: 11090

SEQ ID NO: 11128 - DNA, 201 bp, Homo sapiens; identical to SEQ ID NO: 11091

SEQ ID NO: 11129 - DNA, 108 bp, Homo sapiens; identical to SEQ ID NO: 11092

SEQ ID NO: 11130 - DNA, 201 bp, Homo sapiens; identical to SEQ ID NO: 11093

SEQ ID NO: 11131 - DNA, 201 bp, Homo sapiens; identical to SEQ ID NO: 11094

SEQ ID NO: 11132 - DNA, 201 bp, Homo sapiens; identical to SEQ ID NO: 11095

SEQ ID NO: 11133 - DNA, 201 bp, Homo sapiens; identical to SEQ ID NO: 11096

SEQ ID NO: 11134 - DNA, 201 bp, Homo sapiens; identical to SEQ ID NO: 11098

SEQ ID NO: 11135 - DNA, 201 bp, Homo sapiens; identical to SEQ ID NO: 11099

SEQ ID NO: 11136 - DNA, 201 bp, Homo sapiens; identical to SEQ ID NO: 11100

SEQ ID NO: 11137 - DNA, 201 bp, Homo sapiens; identical to SEQ ID NO: 11101

SEQ ID NO: 11138 - DNA, 201 bp, Homo sapiens; identical to SEQ ID NO: 11102

SEQ ID NO: 11139 - DNA, 201 bp, Homo sapiens; identical to SEQ ID NO: 11103

SEQ ID NO: 11140 - DNA, 201 bp, Homo sapiens; identical to SEQ ID NO: 11104

SEQ ID NO: 11141 - DNA, 201 bp, Homo sapiens; identical to SEQ ID NO: 11105

SEQ ID NO: 11142 - DNA, 201 bp, Homo sapiens; identical to SEQ ID NO: 11106

SEQ ID NO: 11143 - DNA, 201 bp, Homo sapiens; identical to SEQ ID NO: 11107

SEQ ID NO: 11144 - DNA, 201 bp, Homo sapiens; identical to SEQ ID NO: 11108

SEQ ID NO: 11145 - DNA, 201 bp, Homo sapiens; identical to SEQ ID NO: 11109

SEQ ID NO: 11146 - DNA, 201 bp, Homo sapiens; identical to SEQ ID NO: 11110

SEQ ID NO: 11147 - DNA, 201 bp, Homo sapiens; identical to SEQ ID NO: 11111

SEQ ID NO: 11148 - DNA, 201 bp, Homo sapiens; identical to SEQ ID NO: 11112

SEQ ID NO: 11149 - DNA, 201 bp, Homo sapiens
cgcggcgtggtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataagtatgacctaaaaaccgaaacagctcctcttgttgttg

SEQ ID NO: 11150 - DNA, 201 bp, Homo sapiens; identical to SEQ ID NO: 11114

SEQ ID NO: 11151 - DNA, 201 bp, Homo sapiens; identical to SEQ ID NO: 11115

SEQ ID NO: 11152 - DNA, 201 bp, Homo sapiens; identical to SEQ ID NO: 11117

SEQ ID NO: 11153 - DNA, 201 bp, Homo sapiens; identical to SEQ ID NO: 11116

SEQ ID NO: 11154 - DNA, 201 bp, Homo sapiens; identical to SEQ ID NO: 11118

SEQ ID NO: 11155 - DNA, 201 bp, Homo sapiens; identical to SEQ ID NO: 11119

SEQ ID NO: 11156 - DNA, 201 bp, Homo sapiens
gtgcccggctggcgcggcgtggtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataagtatgacctaaaaaccgaaacagctc

SEQ ID NO: 11157 - DNA, 201 bp, Homo sapiens
ccacctgcagcctgactgcgccgcaagacccggatccggctggaatggcaacctacagctggagtcgagagtctggggcaatggggcaggaaaagtgttaytacattaccatctttgcctctgcgcaccccgagaagctcaccttgtggtctacggtcctgtccacctaccactttgggggcaatgcctcagcagctggga

SEQ ID NO: 11158 - DNA, 201 bp, Homo sapiens
gggtgagtgactcgcccgaggctacgtagcacacacaggagtcacatttggacccaaataacccagagctcctccaggctccagtgcacctgcctcctctytgccccgtgcctgttgccacccatcctgcgggggaaccctagatgctgccatgaaatggaagctgctgcaccctgctgggcctggcatccgtggggcagg

SEQ ID NO: 11159 - DNA, 201 bp, Homo sapiens
agtggctctgaatatcagcgtcggaaccaacgggaccaccatgtattggccagcccgggctcagagcatgacgtattgcattgaatggcagcctgtgggcyaggacgggggccttgccacctgcagcctgactgcgccgcaagacccggatccggctggaatggcaacctacagctggagtcgagagtctggggcaatggg

SEQ ID NO: 11160 - DNA, 201 bp, Homo sapiens
cctgcgggggaaccctagatgctgccatgaaatggaagctgctgcaccctgctgggcctggcatccgtggggcaggagcagaccctgccatttacctgttytggcgtagaatggactgggaatgggggcaaggggggctcagatggatccctggaccctgggctgggcatccacccccaggagcactggatggggagtctg

SEQ ID NO: 11161 - DNA, 201 bp, Homo sapiens
tccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcgctgcctgcagaaccagtgagtgctgttttcaggac

SEQ ID NO: 11162 - DNA, 153 bp, Homo sapiens
gccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctcta

SEQ ID NO: 11163 - DNA, 201 bp, Homo sapiens
tacctgagggtgcccctgagctggccctggatacagagttgtccttggaggatggagacagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 11164 - DNA, 201 bp, Homo sapiens
cccatggaagttgggcgactgcggacctcaggatgatgatactgagtcctgcctctgccccctggagatgaatgtggcccaggaattccagctccgacgayggcagctggggagccaaggaagttcctggagcaagtggagcagccccgtgtgcgttccccctgaaaaccccccacagcctcaggtgagattctcggtgga

SEQ ID NO: 11165 - DNA, 201 bp, Homo sapiens
tcaagggctggcgcctggcacggaggtcacttaccgactacagctccacatgctgtcctgcccgtgtaaggccaaggccaccaggaccctgcacctggggwagatgccctatctctcgggtgctgcctacaacgtggctgtcatctcctcgaaccaatttggtcctggcctgaaccagacgtggcacattcctgccgacac

SEQ ID NO: 11166 - DNA, 201 bp, Homo sapiens
ggctgcagttctccgaccaggctggggtgtctgtgctgtacactgtcacactctgggtggaatcctgggccaggaaccagacagagaagtctcctgaggtvaccctgcagctctacaactcagttaaatatgagcctcctctgggagacatcaaggtgtccaagttggccgggcagctgcgtatggagtgggagaccccgg

SEQ ID NO: 11167 - DNA, 201 bp, Homo sapiens
tctgaatatcagcgtcggaaccaacgggaccaccatgtattggccagcccgggctcagagcatgacgtattgcattgaatggcagcctgtgggccaggacsggggccttgccacctgcagcctgactgcgccgcaagacccggatccggctggaatggcaacctacagctggagtcgagagtctggggcaatggggcagga

SEQ ID NO: 11168 - DNA, 201 bp, Homo sapiens
tctcctcgaaccaatttggtcctggcctgaaccagacgtggcacattcctgccgacacccacacagaaccagtggctctgaatatcagcgtcggaaccaaygggaccaccatgtattggccagcccgggctcagagcatgacgtattgcattgaatggcagcctgtgggccaggacgggggccttgccacctgcagcctga

SEQ ID NO: 11169 - DNA, 201 bp, Homo sapiens
acattcctgccgacacccacacagaaccagtggctctgaatatcagcgtcggaaccaacgggaccaccatgtattggccagcccgggctcagagcatgacrtattgcattgaatggcagcctgtgggccaggacgggggccttgccacctgcagcctgactgcgccgcaagacccggatccggctggaatggcaacctaca

SEQ ID NO: 11170 - DNA, 201 bp, Homo sapiens
acagagaagtctcctgaggtgaccctgcagctctacaactcagttaaatatgagcctcctctgggagacatcaaggtgtccaagttggccgggcagctgcrtatggagtgggagaccccggataaccaggttggtgctgaggtgcagttccggcaccggacacccagcagcccatggaagttgggcgactgcggacctcag

SEQ ID NO: 11171 - DNA, 201 bp, Homo sapiens
tggaagttgggcgactgcggacctcaggatgatgatactgagtcctgcctctgccccctggagatgaatgtggcccaggaattccagctccgacgacggcrgctggggagccaaggaagttcctggagcaagtggagcagccccgtgtgcgttccccctgaaaaccccccacagcctcaggtgagattctcggtggagcag

SEQ ID NO: 11172 - DNA, 201 bp, Homo sapiens
tggcacattcctgccgacacccacacagaaccagtggctctgaatatcagcgtcggaaccaacgggaccaccatgtattggccagcccgggctcagagcaygacgtattgcattgaatggcagcctgtgggccaggacgggggccttgccacctgcagcctgactgcgccgcaagacccggatccggctggaatggcaacc

SEQ ID NO: 11173 - DNA, 201 bp, Homo sapiens
aggagcactggatggggagtctggactcaagggctccctgcagcattgcggggtcttgtagcttggaggatccaggcatatagggaagggggctgtaaacwttgtgggaaaaatgacggtcctcccatcccaccccccaccccaccctcacccccctataaaatgggggtggtgataatgaccttacacagctgttcaaaa

SEQ ID NO: 11174 - DNA, 201 bp, Homo sapiens
ttctggcgtagaatggactgggaatgggggcaaggggggctcagatggatccctggaccctgggctgggcatccacccccaggagcactggatggggagtytggactcaagggctccctgcagcattgcggggtcttgtagcttggaggatccaggcatatagggaagggggctgtaaactttgtgggaaaaatgacggtc

SEQ ID NO: 11175 - DNA, 201 bp, Homo sapiens
gagggtgagtgactcgcccgaggctacgtagcacacacaggagtcacatttggacccaaataacccagagctcctccaggctccagtgcacctgcctcctytctgccccgtgcctgttgccacccatcctgcgggggaaccctagatgctgccatgaaatggaagctgctgcaccctgctgggcctggcatccgtggggca

SEQ ID NO: 11176 - DNA, 201 bp, Homo sapiens
ctggccctggatacagagttgtccttggaggatggagacaggtgcaaggccaaggtcctggggcccagtgggccagacggtcaggggtgcaaccctgccckgggggtgggggggctagacatccatcgctcctgggatatcagggcctggaggcctgagggagaaacgaaaacatccactttgtcttacagacacgaagag

SEQ ID NO: 11177 - DNA, 201 bp, Homo sapiens; identical to SEQ ID NO: 11157

SEQ ID NO: 11178 - DNA, 201 bp, Homo sapiens; identical to SEQ ID NO: 11165

SEQ ID NO: 11179 - DNA, 201 bp, Homo sapiens; identical to SEQ ID NO: 11166

SEQ ID NO: 11180 - DNA, 201 bp, Homo sapiens; identical to SEQ ID NO: 11159

SEQ ID NO: 11181 - DNA, 201 bp, Homo sapiens; identical to SEQ ID NO: 11161

SEQ ID NO: 11182 - DNA, 201 bp, Homo sapiens
caggttggggtttctaggagggcagctccagaggttgcagaacactccgctgcctctccagagccaggcacacagcaggcgctccataaatgttcgttggwcttttctccttgctcagcttcaatgtgttccggagtggggacggggtggctgaacctcgcaggtggcagagaggctcccctggggctgtggggctctacg

SEQ ID NO: 11183 - DNA, 201 bp, Homo sapiens; identical to SEQ ID NO: 11168

SEQ ID NO: 11184 - DNA, 201 bp, Homo sapiens; identical to SEQ ID NO: 11167

SEQ ID NO: 11185 - DNA, 201 bp, Homo sapiens
cacagagacccaagttaccctcagtggcctgcgggctggtgtagcctacacggtgcaggtgcgagcagacacagcgtggctgaggggtgtctggagccagycccagcgcttcagcatcgaagtgcaggtttctgattggctcatcttcttcgcctccctggggagcttcctgagcatccttctcgtgggcgtccttggcta

SEQ ID NO: 11186 - DNA, 201 bp, Homo sapiens; identical to SEQ ID NO: 11169

SEQ ID NO: 11187 - DNA, 201 bp, Homo sapiens
acaggtgtcagagcatcccgtgcagcccacagagacccaagttaccctcagtggcctgcgggctggtgtagcctacacggtgcaggtgcgagcagacacarcgtggctgaggggtgtctggagccagccccagcgcttcagcatcgaagtgcaggtttctgattggctcatcttcttcgcctccctggggagcttcctgag

SEQ ID NO: 11188 - DNA, 201 bp, Homo sapiens; identical to SEQ ID NO: 11164

SEQ ID NO: 11189 - DNA, 201 bp, Homo sapiens; identical to SEQ ID NO: 11172

SEQ ID NO: 11190 - DNA, 201 bp, Homo sapiens; identical to SEQ ID NO: 11171

SEQ ID NO: 11191 - DNA, 201 bp, Homo sapiens; identical to SEQ ID NO: 11170

SEQ ID NO: 11192 - DNA, 201 bp, Homo sapiens; identical to SEQ ID NO: 11157

SEQ ID NO: 11193 - DNA, 201 bp, Homo sapiens; identical to SEQ ID NO: 11158

SEQ ID NO: 11194 - DNA, 201 bp, Homo sapiens; identical to SEQ ID NO: 11159

SEQ ID NO: 11195 - DNA, 201 bp, Homo sapiens; identical to SEQ ID NO: 11160

SEQ ID NO: 11196 - DNA, 201 bp, Homo sapiens; identical to SEQ ID NO: 11161

SEQ ID NO: 11197 - DNA, 201 bp, Homo sapiens; identical to SEQ ID NO: 11182

SEQ ID NO: 11198 - DNA, 201 bp, Homo sapiens
ccctgagctggccctggatacagagttgtccttggaggatggagacaggtgcaaggccaagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 11199 - DNA, 201 bp, Homo sapiens; identical to SEQ ID NO: 11185

SEQ ID NO: 11200 - DNA, 201 bp, Homo sapiens; identical to SEQ ID NO: 11187

SEQ ID NO: 11201 - DNA, 201 bp, Homo sapiens; identical to SEQ ID NO: 11164

SEQ ID NO: 11202 - DNA, 201 bp, Homo sapiens; identical to SEQ ID NO: 11165

SEQ ID NO: 11203 - DNA, 201 bp, Homo sapiens; identical to SEQ ID NO: 11166

SEQ ID NO: 11204 - DNA, 201 bp, Homo sapiens; identical to SEQ ID NO: 11167

SEQ ID NO: 11205 - DNA, 201 bp, Homo sapiens; identical to SEQ ID NO: 11168

SEQ ID NO: 11206 - DNA, 201 bp, Homo sapiens; identical to SEQ ID NO: 11169

SEQ ID NO: 11207 - DNA, 201 bp, Homo sapiens; identical to SEQ ID NO: 11172

SEQ ID NO: 11208 - DNA, 201 bp, Homo sapiens; identical to SEQ ID NO: 11171

SEQ ID NO: 11209 - DNA, 201 bp, Homo sapiens; identical to SEQ ID NO: 11170

SEQ ID NO: 11210 - DNA, 201 bp, Homo sapiens; identical to SEQ ID NO: 11173

SEQ ID NO: 11211 - DNA, 201 bp, Homo sapiens; identical to SEQ ID NO: 11175

SEQ ID NO: 11212 - DNA, 201 bp, Homo sapiens; identical to SEQ ID NO: 11174

SEQ ID NO: 11213 - DNA, 201 bp, Homo sapiens; identical to SEQ ID NO: 11157

SEQ ID NO: 11214 - DNA, 201 bp, Homo sapiens; identical to SEQ ID NO: 11158

SEQ ID NO: 11215 - DNA, 201 bp, Homo sapiens; identical to SEQ ID NO: 11159

SEQ ID NO: 11216 - DNA, 201 bp, Homo sapiens; identical to SEQ ID NO: 11160

SEQ ID NO: 11217 - DNA, 201 bp, Homo sapiens; identical to SEQ ID NO: 11161

SEQ ID NO: 11218 - DNA, 153 bp, Homo sapiens; identical to SEQ ID NO: 11162

SEQ ID NO: 11219 - DNA, 201 bp, Homo sapiens; identical to SEQ ID NO: 11198

SEQ ID NO: 11220 - DNA, 201 bp, Homo sapiens; identical to SEQ ID NO: 11185

SEQ ID NO: 11221 - DNA, 201 bp, Homo sapiens; identical to SEQ ID NO: 11187

SEQ ID NO: 11222 - DNA, 201 bp, Homo sapiens; identical to SEQ ID NO: 11164

SEQ ID NO: 11223 - DNA, 201 bp, Homo sapiens; identical to SEQ ID NO: 11165

SEQ ID NO: 11224 - DNA, 201 bp, Homo sapiens; identical to SEQ ID NO: 11166

SEQ ID NO: 11225 - DNA, 201 bp, Homo sapiens; identical to SEQ ID NO: 11167

SEQ ID NO: 11226 - DNA, 201 bp, Homo sapiens; identical to SEQ ID NO: 11168

SEQ ID NO: 11227 - DNA, 201 bp, Homo sapiens; identical to SEQ ID NO: 11169

SEQ ID NO: 11228 - DNA, 201 bp, Homo sapiens; identical to SEQ ID NO: 11172

SEQ ID NO: 11229 - DNA, 201 bp, Homo sapiens; identical to SEQ ID NO: 11171

SEQ ID NO: 11230 - DNA, 201 bp, Homo sapiens; identical to SEQ ID NO: 11170

SEQ ID NO: 11231 - DNA, 201 bp, Homo sapiens; identical to SEQ ID NO: 11173

SEQ ID NO: 11232 - DNA, 201 bp, Homo sapiens; identical to SEQ ID NO: 11174

SEQ ID NO: 11233 - DNA, 201 bp, Homo sapiens; identical to SEQ ID NO: 11175

SEQ ID NO: 11234 - DNA, 201 bp, Homo sapiens
agatgctcctggtgttgctggtgctctcgtggctgccgcatgggggcgccctgtctctggccgaggcgagccgcgcaagtttcccgggaccctcagagttrcactccgaagactccagattccgagagttgcggaaacgctacgaggacctgctaaccaggctgcgggccaaccagagctgggaagattcgaacaccgacc

SEQ ID NO: 11235 - DNA, 201 bp, Homo sapiens
gttccggctgtccccgacggcgtcaaggtcgtgggacgtgacacgaccgctgcggcgtcagctcagccttgcaagaccccaggcgcccgcgctgcacctgmgactgtcgccgccgccgtcgcagtcggaccaactgctggcagaatcttcgtccgcacggccccagctggagttgcacttgcggccgcaagccgccagggg

SEQ ID NO: 11236 - DNA, 201 bp, Homo sapiens
gctcctggtgttgctggtgctctcgtggctgccgcatgggggcgccctgtctctggccgaggcgagccgcgcaagtttcccgggaccctcagagttgcacwccgaagactccagattccgagagttgcggaaacgctacgaggacctgctaaccaggctgcgggccaaccagagctgggaagattcgaacaccgacctcgt

SEQ ID NO: 11237 - DNA, 201 bp, Homo sapiens
ggtccgcgcgtcgctggaagacctgggctgggccgattgggtgctgtcgccacgggaggtgcaagtgaccatgtgcatcggcgcgtgcccgagccagttcsgggcggcaaacatgcacgcgcagatcaagacgagcctgcaccgcctgaagcccgacacggtgccagcgccctgctgcgtgcccgccagctacaatcccat

SEQ ID NO: 11238 - DNA, 201 bp, Homo sapiens
accgacaccggggtgtcgctccagacctatgatgacttgttagccaaagactgccactgcatatgagcagtcctggtccttccactgtgcacctgcgcggrggacgcgacctcagttgtcctgccctgtggaatgggctcaaggttcctgagacacccgattcctgcccaaacagctgtatttatataagtctgttattta

SEQ ID NO: 11239 - DNA, 201 bp, Homo sapiens
acaccggggtgtcgctccagacctatgatgacttgttagccaaagactgccactgcatatgagcagtcctggtccttccactgtgcacctgcgcgggggasgcgacctcagttgtcctgccctgtggaatgggctcaaggttcctgagacacccgattcctgcccaaacagctgtatttatataagtctgttatttattat

SEQ ID NO: 11240 - DNA, 201 bp, Homo sapiens
cttgttagccaaagactgccactgcatatgagcagtcctggtccttccactgtgcacctgcgcgggggacgcgacctcagttgtcctgccctgtggaatgsgctcaaggttcctgagacacccgattcctgcccaaacagctgtatttatataagtctgttatttattattaatttattggggtgaccttcttggggactc

SEQ ID NO: 11241 - DNA, 201 bp, Homo sapiens
cttccactgtgcacctgcgcgggggacgcgacctcagttgtcctgccctgtggaatgggctcaaggttcctgagacacccgattcctgcccaaacagctgyatttatataagtctgttatttattattaatttattggggtgaccttcttggggactcgggggctggtctgatggaactgtgtatttatttaaaactctgg

SEQ ID NO: 11242 - DNA, 201 bp, Homo sapiens
ccgacctcgtcccggcccctgcagtccggatactcacgccagaagtgcggctgggatccggcggccacctgcacctgcgtatctctcgggccgcccttccygaggggctccccgaggcctcccgccttcaccgggctctgttccggctgtccccgacggcgtcaaggtcgtgggacgtgacacgaccgctgcggcgtcagc

SEQ ID NO: 11243 - DNA, 201 bp, Homo sapiens
gacaaggagagccaggaggagctgggccccaacctcatccaaaagcacagactcccaggctggaatggtgtcctcatatcgaggaagaggatactgaggcycagaaatgtgccctagctttactaggagcgcccccacctaaagatcctccccctaaatacacccccagaccccgcccagctgtggtcattggagtgttta

SEQ ID NO: 11244 - DNA, 201 bp, Homo sapiens
gggccgcccttcccgaggggctccccgaggcctcccgccttcaccgggctctgttccggctgtccccgacggcgtcaaggtcgtgggacgtgacacgacckctgcggcgtcagctcagccttgcaagaccccaggcgcccgcgctgcacctgcgactgtcgccgccgccgtcgcagtcggaccaactgctggcagaatctt

SEQ ID NO: 11245 - DNA, 201 bp, Homo sapiens
actgctggcagaatcttcgtccgcacggccccagctggagttgcacttgcggccgcaagccgccagggggcgccgcagagcgcgtgcgcgcaacggggacsactgtccgctcgggcccgggcgttgctgccgtctgcacacggtccgcgcgtcgctggaagacctgggctgggccgattgggtgctgtcgccacgggaggt

SEQ ID NO: 11246 - DNA, 201 bp, Homo sapiens
acaaagtccggggactataaaggccggtccggcagcatctggtcagtcccagctcagagccgcaacctgcacagccatgcccgggcaagaactcaggacgstgaatggctctcagatgctcctggtgttgctggtgctctcgtggctgccgcatgggggcgccctgtctctggccgaggcgagccgcgcaagtttcccggg

SEQ ID NO: 11247 - DNA, 201 bp, Homo sapiens
ttttgtgtggtggcacctcctacgtcaaacatgaagtgtgtttccttcagtgcatctgggaagatttctacctgaccaacagttccttcagcttccatttygcccctcatttatccctcaacccccagcccacaggtgtttatacagctcagctttttgtcttttctgaggagaaacaaataagaccataaagggaaagga

SEQ ID NO: 11248 - DNA, 201 bp, Homo sapiens
cagcttccatttcgcccctcatttatccctcaacccccagcccacaggtgtttatacagctcagctttttgtcttttctgaggagaaacaaataagaccayaaagggaaaggattcatgtggaatataaagatggctgactttgctctttcttgactcttgttttcagtttcaattcagtgctgtacttgatgacagacac

SEQ ID NO: 11249 - DNA, 201 bp, Homo sapiens
gtgtttccttcagtgcatctgggaagatttctacctgaccaacagttccttcagcttccatttcgcccctcatttatccctcaacccccagcccacaggtstttatacagctcagctttttgtcttttctgaggagaaacaaataagaccataaagggaaaggattcatgtggaatataaagatggctgactttgctcttt

SEQ ID NO: 11250 - DNA, 201 bp, Homo sapiens
gagatcctttaaatccttccatgaaacgttttgtgtggtggcacctcctacgtcaaacatgaagtgtgtttccttcagtgcatctgggaagatttctaccygaccaacagttccttcagcttccatttcgcccctcatttatccctcaacccccagcccacaggtgtttatacagctcagctttttgtcttttctgaggag

SEQ ID NO: 11251 - DNA, 201 bp, Homo sapiens
ttgccagccctggtcatgcagtggccatggagaatgtgtagaaatcatcaataattacacctgcaactgtgatgtggggtactatgggccccagtgtcagyttgtgattcagtgtgagcctttggaggccccagagctgggtaccatggactgtactcaccctttgggaaacttcagcttcagctcacagtgtgccttcag

SEQ ID NO: 11252 - DNA, 201 bp, Homo sapiens
ctgcaactgtgatgtggggtactatgggccccagtgtcagtttgtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaa

SEQ ID NO: 11253 - DNA, 201 bp, Homo sapiens
agtatctggagaagactctgcctttcagtcgttcttactactggataggaatccggaagataggaggaatatggacgtgggtgggaaccaacaaatctctyactgaagaagcagagaactggggagatggtgagcccaacaacaagaagaacaaggaggactgcgtggagatctatatcaagagaaacaaagatgcaggca

SEQ ID NO: 11254 - DNA, 201 bp, Homo sapiens
gttcttactactggataggaatccggaagataggaggaatatggacgtgggtgggaaccaacaaatctcttactgaagaagcagagaactggggagatggygagcccaacaacaagaagaacaaggaggactgcgtggagatctatatcaagagaaacaaagatgcaggcaaatggaacgatgacgcctgccacaaactaa

SEQ ID NO: 11255 - DNA, 201 bp, Homo sapiens; identical to SEQ ID NO: 11247

SEQ ID NO: 11256 - DNA, 201 bp, Homo sapiens; identical to SEQ ID NO: 11248

SEQ ID NO: 11257 - DNA, 201 bp, Homo sapiens; identical to SEQ ID NO: 11249

SEQ ID NO: 11258 - DNA, 201 bp, Homo sapiens
gctgcaagtgacatctctttgatgtcatatggaagagttaaaacaggtggagaaattccttgattcacaatgaaatgctctcctttcccctgcccccagamcttttatccacttacctagattctacatattctttaaatttcatctcaggcctccctcaaccccaccacttcttttataactagtcctttactaatccaa

SEQ ID NO: 11259 - DNA, 201 bp, Homo sapiens; identical to SEQ ID NO: 11250

SEQ ID NO: 11260 - DNA, 201 bp, Homo sapiens; identical to SEQ ID NO: 11251

SEQ ID NO: 11261 - DNA, 201 bp, Homo sapiens; identical to SEQ ID NO: 11252

SEQ ID NO: 11262 - DNA, 201 bp, Homo sapiens; identical to SEQ ID NO: 11253

SEQ ID NO: 11263 - DNA, 201 bp, Homo sapiens; identical to SEQ ID NO: 11254

SEQ ID NO: 11264 - DNA, 201 bp, Homo sapiens; identical to SEQ ID NO: 11251

SEQ ID NO: 11265 - DNA, 201 bp, Homo sapiens; identical to SEQ ID NO: 11252

SEQ ID NO: 11266 - DNA, 201 bp, Homo sapiens; identical to SEQ ID NO: 11253

SEQ ID NO: 11267 - DNA, 201 bp, Homo sapiens; identical to SEQ ID NO: 11258

SEQ ID NO: 11268 - DNA, 201 bp, Homo sapiens; identical to SEQ ID NO: 11254

SEQ ID NO: 11269 - DNA, 201 bp, Homo sapiens; identical to SEQ ID NO: 11251

SEQ ID NO: 11270 - DNA, 201 bp, Homo sapiens; identical to SEQ ID NO: 11252

SEQ ID NO: 11271 - DNA, 201 bp, Homo sapiens; identical to SEQ ID NO: 11253

SEQ ID NO: 11272 - DNA, 201 bp, Homo sapiens; identical to SEQ ID NO: 11258

SEQ ID NO: 11273 - DNA, 201 bp, Homo sapiens; identical to SEQ ID NO: 11254

SEQ ID NO: 11274 - DNA, 201 bp, Homo sapiens; identical to SEQ ID NO: 11247

SEQ ID NO: 11275 - DNA, 201 bp, Homo sapiens; identical to SEQ ID NO: 11248

SEQ ID NO: 11276 - DNA, 201 bp, Homo sapiens; identical to SEQ ID NO: 11249

SEQ ID NO: 11277 - DNA, 201 bp, Homo sapiens; identical to SEQ ID NO: 11258

SEQ ID NO: 11278 - DNA, 201 bp, Homo sapiens; identical to SEQ ID NO: 11250

SEQ ID NO: 11279 - DNA, 201 bp, Homo sapiens; identical to SEQ ID NO: 11251

SEQ ID NO: 11280 - DNA, 201 bp, Homo sapiens; identical to SEQ ID NO: 11252

SEQ ID NO: 11281 - DNA, 201 bp, Homo sapiens; identical to SEQ ID NO: 11253

SEQ ID NO: 11282 - DNA, 201 bp, Homo sapiens; identical to SEQ ID NO: 11254

SEQ ID NO: 11283 - DNA, 201 bp, Homo sapiens
ggtcctgggcgtcctggtgggcagtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagc

SEQ ID NO: 11284 - DNA, 201 bp, Homo sapiens
ctgtgtgcagtatgtgcagaaacatatttccgcggaaaacacgaaagggagccaaacaagccgctcctacacttcgctggtcctgggcgtcctggtgggcrgtttcatcattgctggtgtggctgtaggcatcttcctgtgcacaggtggacggcgatgttaattactctccagccccgtcagaaggggctggattgatgg

SEQ ID NO: 11285 - DNA, 201 bp, Homo sapiens
cacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaagggagccaaacaagccgctcctacacttcgctggtcctgggcgtcctggtgggcagttt

SEQ ID NO: 11286 - DNA, 201 bp, Homo sapiens
catgctcggaggagtgactttaaagcttttctacttgcttcctagaactgcagccagcggagcccgcagccggcccgagccaggaacccaggtccggagcytcaacttcaggatgttgacaacattgctgccgatactgctgctgtctggctgggccttttgtagccaagacgcctcagatggcctccaaagacttcatat

SEQ ID NO: 11287 - DNA, 201 bp, Homo sapiens
tgaagccagactccccaactgaaacaccagaaggtttggagtgacagctcctttcttctcccacatctgcccactgaagatttgagggaggggagatggaraggagaggtggacaaagtacttggtttgctaagaacctaagaacgtgtatgctttgctgaattagtctgataagtgaatgtttatctatctttgtggaaa

SEQ ID NO: 11288 - DNA, 201 bp, Homo sapiens
agataatggagttggggcaggaagcctatggcccatcctccaaagacagacagaatcacctgaggcgttcaaaagatataaccaaataaacaagtcatccmcaatcaaaatacaacattcaatacttccaggtgtgtcagacttgggatgggacgctgatataatagggtagaaagaagtaacacgaagaagtggtggaaa

SEQ ID NO: 11289 - DNA, 201 bp, Homo sapiens
tcactgtgaagccagactccccaactgaaacaccagaaggtttggagtgacagctcctttcttctcccacatctgcccactgaagatttgagggaggggaratggagaggagaggtggacaaagtacttggtttgctaagaacctaagaacgtgtatgctttgctgaattagtctgataagtgaatgtttatctatctttg

SEQ ID NO: 11290 - DNA, 201 bp, Homo sapiens
gcggagcccgcagccggcccgagccaggaacccaggtccggagcctcaacttcaggatgttgacaacattgctgccgatactgctgctgtctggctgggcyttttgtagccaagacgcctcagatggcctccaaagacttcatatgctccagatctcctacttccgcgacccctatcacgtgtggtaccagggcaacgcgt

SEQ ID NO: 11291 - DNA, 201 bp, Homo sapiens; identical to SEQ ID NO: 11283

SEQ ID NO: 11292 - DNA, 201 bp, Homo sapiens; identical to SEQ ID NO: 11284

SEQ ID NO: 11293 - DNA, 201 bp, Homo sapiens; identical to SEQ ID NO: 11285

SEQ ID NO: 11294 - DNA, 201 bp, Homo sapiens
ccagactccgcccctcccagacggtcctcacttctcttttccctagactgcagccagcggagcccgcagccggcccgagccaggaacccaggtccggagcytcaacttcaggatgttgacaacattgctgccgatactgctgctgtctggctgggccttttgtagccaagacgcctcagatggcctccaaagacttcatat

SEQ ID NO: 11295 - DNA, 201 bp, Homo sapiens; identical to SEQ ID NO: 11287

SEQ ID NO: 11296 - DNA, 201 bp, Homo sapiens; identical to SEQ ID NO: 11288

SEQ ID NO: 11297 - DNA, 201 bp, Homo sapiens; identical to SEQ ID NO: 11289

SEQ ID NO: 11298 - DNA, 201 bp, Homo sapiens; identical to SEQ ID NO: 11290

SEQ ID NO: 11299 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatgagctgtggcatctccgtggagttctgcagccacataaccagagcgttcacg

SEQ ID NO: 11300 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatgagctgtggcatctccgtggagttctgcagccacataaccagagcgttc

SEQ ID NO: 11301 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacagtgtgttttatgtctt

SEQ ID NO: 11302 - DNA, 201 bp, Homo sapiens
cgccatggtcttggtcaacatgtttggagttatgtggctctggggcatcagtctgaacgctgtatccttggtcaacctggtgatgagctgtggcatctccrtggagttctgcagccacataaccagagcgttcacggtgagcatgaaaggcagccgcgtggagcgcgcggaagaggcacttgcccacatgggcagctccgt

SEQ ID NO: 11303 - DNA, 201 bp, Homo sapiens
ggcctgggaaaaagagtttattaattttgtgaaaaactacaagaatcccaatctgaccatttccttcactgctgaacgaagtattgaagatgaactaaatygtgaaagtgacagtgatgtcttcaccgttgtaattagctatgccatcatgtttctatatatttccctagccttggggcacatcaaaagctgtcgcaggct

SEQ ID NO: 11304 - DNA, 201 bp, Homo sapiens
accagagcgttcacggtgagcatgaaaggcagccgcgtggagcgcgcggaagaggcacttgcccacatgggcagctccgtgttcagtggaatcacacttavaaaatttggagggattgtggtgttggcttttgccaaatctcaaattttccagatattctacttcaggatgtatttggccatggtcttactgggagccact

SEQ ID NO: 11305 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatgagctgtggcatctccgtggagttctgcagccacataaccagagcgttcacggtgagcatgaaaggcagccgcg

SEQ ID NO: 11306 - DNA, 201 bp, Homo sapiens
cagtgtgttttatgtcttctacgaacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcaacatgtttggagttatgtggctctggggcatcag

SEQ ID NO: 11307 - DNA, 201 bp, Homo sapiens
acacttacaaaatttggagggattgtggtgttggcttttgccaaatctcaaattttccagatattctacttcaggatgtatttggccatggtcttactggragccactcacggattaatatttctccctgtcttactcagttacatagggccatcagtaaataaagccaaaagttgtgccactgaagagcgatacaaagga

SEQ ID NO: 11308 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtggattcgaaggtctcactaggcatcgcgggcatcttgatcgtgctgagctcggtggcttgctccttgggtgtcttca

SEQ ID NO: 11309 - DNA, 201 bp, Homo sapiens
agagtgtggaattgcatatggggacaagaggtacaattgcgaatattctggcccaccaaaaccattgccaaaggatggatatgacttagtgcaggaactcygtccaggattcttctttggcaatgtcagtctctgttgtgatgttcggcagcttcagacactaaaagacaacctgcagctgcctctacagtttctgtccag

SEQ ID NO: 11310 - DNA, 201 bp, Homo sapiens
tcttccaaggggcagaacatggtgtgcggcggcatgggctgcaacaatgattccctggtgcagcagatatttaacgcggcgcagctggacaactatacccraataggcttcgccccctcgtcctggatcgacgattatttcgactgggtgaagccacagtcgtcttgctgtcgagtggacaatatcactgaccagttctgc

SEQ ID NO: 11311 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactatacccgaataggcttcgccccctcgtcctggatcgacgattatttcgactgggtgaagccacagtcgtcttgctgtcgagtggacaat

SEQ ID NO: 11312 - DNA, 201 bp, Homo sapiens
agtagatattggattggatcagtctctttcgatgccagatgactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 11313 - DNA, 201 bp, Homo sapiens
caaagtagatattggattggatcagtctctttcgatgccagatgactcctacatggtggattatttcaaatccatcagtcagtacctgcatgcgggtccgyctgtgtactttgtcctggaggaagggcacgactacacttcttccaaggggcagaacatggtgtgcggcggcatgggctgcaacaatgattccctggtgca

SEQ ID NO: 11314 - DNA, 201 bp, Homo sapiens
actgcaccaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 11315 - DNA, 201 bp, Homo sapiens
taccatcactcctgtgttttcagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 11316 - DNA, 201 bp, Homo sapiens
ttcctttcggataaccctaaccccaagtgtggcaaagggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 11317 - DNA, 201 bp, Homo sapiens
gaagaaagcccgacttatagccagtaatgtcaccgaaaccatgggcattaacggcagtgcctaccgagtatttccttacagtgtgttttatgtcttctacraacagtacctgaccatcattgacgacactatcttcaacctcggtgtgtccctgggcgcgatatttctggtgaccatggtcctcctgggctgtgagctctg

SEQ ID NO: 11318 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgttttcacagtcctgtgttt

SEQ ID NO: 11319 - DNA, 201 bp, Homo sapiens
acagtcgtcttgctgtcgagtggacaatatcactgaccagttctgcaatgcttcagtggttgaccctgcctgcgttcgctgcaggcctctgactccggaargcaaacagaggcctcaggggggagacttcatgagattcctgcccatgttcctttcggataaccctaaccccaagtgtggcaaagggggacatgctgccta

SEQ ID NO: 11320 - DNA, 201 bp, Homo sapiens
gttacaatactacgtcggacagagttttgccaatgcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 11321 - DNA, 201 bp, Homo sapiens
tgattccctggtgcagcagatatttaacgcggcgcagctggacaactatacccgaataggcttcgccccctcgtcctggatcgacgattatttcgactggrtgaagccacagtcgtcttgctgtcgagtggacaatatcactgaccagttctgcaatgcttcagtggttgaccctgcctgcgttcgctgcaggcctctgac

SEQ ID NO: 11322 - DNA, 201 bp, Homo sapiens
ctactgaacctgttttgtgagctgacatgtagccctcgacagagtcagtttttgaatgttacagctactgaagattatgttgatcctgttacaaaccagaygaaaacaaatgtgaaagagttacaatactacgtcggacagagttttgccaatgcaatgtacaatgcctgccgggatgtggaggccccctcaagtaatgac

SEQ ID NO: 11323 - DNA, 201 bp, Homo sapiens
gagactgtagcatttttcttaggagcattgtccgtgatgccagccgtgcacaccttctctctctttgcgggattggcagtcttcattgactttcttctgcmgattacctgtttcgtgagtctcttggggttagacattaaacgtcaagagaaaaatcggctagacatcttttgctgtgtcagaggtgctgaagatggaaca

SEQ ID NO: 11324 - DNA, 201 bp, Homo sapiens
ggcgcgatatttctggtgaccatggtcctcctgggctgtgagctctggtctgcagtcatcatgtgtgccaccatcgccatggtcttggtcaacatgtttgkagttatgtggctctggggcatcagtctgaacgctgtatccttggtcaacctggtgatgagctgtggcatctccgtggagttctgcagccacataaccaga

SEQ ID NO: 11325 - DNA, 201 bp, Homo sapiens
catgtttctatatatttccctagccttggggcacatcaaaagctgtcgcaggcttctggtggattcgaaggtctcactaggcatcgcgggcatcttgatcrtgctgagctcggtggcttgctccttgggtgtcttcagctacattgggttgcccttgaccctcattgtgattgaagtcatcccgttcctggtgctggctgt

SEQ ID NO: 11326 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatgcaatgtacaatgcctgccgggatg

SEQ ID NO: 11327 - DNA, 201 bp, Homo sapiens
cctggtgtttgtccgggtcacaaccaatccagttgacctctggtcagcccccagcagccaggctcgcctggaaaaagagtactttgaccagcactttgggmctttcttccggacggagcagctcatcatccgggcccctctcactgacaaacacatttaccagccatacccttcgggagctgatgtaccctttggacctcc

SEQ ID NO: 11328 - DNA, 201 bp, Homo sapiens
tagccttggggcacatcaaaagctgtcgcaggcttctggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 11329 - DNA, 201 bp, Homo sapiens
cttctcgctggtcttcattactgcgtgttcgtcaggcctggtgtttgtccgggtcacaaccaatccagttgacctctggtcagcccccagcagccaggctygcctggaaaaagagtactttgaccagcactttgggcctttcttccggacggagcagctcatcatccgggcccctctcactgacaaacacatttaccagcc

SEQ ID NO: 11330 - DNA, 201 bp, Homo sapiens
atcgcgggcatcttgatcgtgctgagctcggtggcttgctccttgggtgtcttcagctacattgggttgcccttgaccctcattgtgattgaagtcatccygttcctggtgctggctgttggagtggacaacatcttcattctggtgcaggcctaccagagagatgaacgtcttcaaggggaaaccctggatcagcagctg

SEQ ID NO: 11331 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtggattcgaaggtctcactaggcatcgcgggcatcttgatcgtg

SEQ ID NO: 11332 - DNA, 201 bp, Homo sapiens
tacagagaagctccagagggcccaggcctgggaaaaagagtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 11333 - DNA, 201 bp, Homo sapiens
ggattcgaaggtctcactaggcatcgcgggcatcttgatcgtgctgagctcggtggcttgctccttgggtgtcttcagctacattgggttgcccttgaccytcattgtgattgaagtcatcccgttcctggtgctggctgttggagtggacaacatcttcattctggtgcaggcctaccagagagatgaacgtcttcaagg

SEQ ID NO: 11334 - DNA, 201 bp, Homo sapiens
tgtgtcagaggtgctgaagatggaacaagcgtccaggcctcagagagctgtttgtttcgcttcttcaaaaactcctattctccacttctgctaaaggactrgatgagaccaattgtgatagcaatatttgtgggtgttctgtcattcagcatcgcagtcctgaacaaagtagatattggattggatcagtctctttcgatg

SEQ ID NO: 11335 - DNA, 201 bp, Homo sapiens
ggctcgcctggaaaaagagtactttgaccagcactttgggcctttcttccggacggagcagctcatcatccgggcccctctcactgacaaacacatttacyagccatacccttcgggagctgatgtaccctttggacctccgcttgacatacagatactgcaccaggttcttgacttacaaatagccatcgaaaacattac

SEQ ID NO: 11336 - DNA, 201 bp, Homo sapiens
gcttcagacactaaaagacaacctgcagctgcctctacagtttctgtccagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 11337 - DNA, 201 bp, Homo sapiens
tttcttctcgctggtcttcattactgcgtgttcgtcaggcctggtgtttgtccgggtcacaaccaatccagttgacctctggtcagcccccagcagccagsctcgcctggaaaaagagtactttgaccagcactttgggcctttcttccggacggagcagctcatcatccgggcccctctcactgacaaacacatttacca

SEQ ID NO: 11338 - DNA, 201 bp, Homo sapiens
cagctggacaactatacccgaataggcttcgccccctcgtcctggatcgacgattatttcgactgggtgaagccacagtcgtcttgctgtcgagtggacartatcactgaccagttctgcaatgcttcagtggttgaccctgcctgcgttcgctgcaggcctctgactccggaaggcaaacagaggcctcaggggggagac

SEQ ID NO: 11339 - DNA, 201 bp, Homo sapiens
tgcaggcctctgactccggaaggcaaacagaggcctcaggggggagacttcatgagattcctgcccatgttcctttcggataaccctaaccccaagtgtgrcaaagggggacatgctgcctatagttctgcagttaacatcctccttggccatggcaccagggtcggagccacgtacttcatgacctaccacaccgtgctg

SEQ ID NO: 11340 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccagagagatgaacgtcttcaaggggaaaccctggatcagcagctgggcagggtcctaggagaagtggctcccagtatgttc

SEQ ID NO: 11341 - DNA, 201 bp, Homo sapiens
gaggaagggcacgactacacttcttccaaggggcagaacatggtgtgcggcggcatgggctgcaacaatgattccctggtgcagcagatatttaacgcggygcagctggacaactatacccgaataggcttcgccccctcgtcctggatcgacgattatttcgactgggtgaagccacagtcgtcttgctgtcgagtggac

SEQ ID NO: 11342 - DNA, 201 bp, Homo sapiens
gtccatgggatggagcccatgaacaatgccaccaaaggctgtgacgagtctgtggatgaggtcacagcaccatgtagctgccaagactgctctattgtctrtggccccaagccccagcccccacctcctcctgctccctggacgatccttggcttggacgccatgtatgtcatcatgtggatcacctacatggcgtttttg

SEQ ID NO: 11343 - DNA, 201 bp, Homo sapiens
caaatccatcagtcagtacctgcatgcgggtccgcctgtgtactttgtcctggaggaagggcacgactacacttcttccaaggggcagaacatggtgtgcrgcggcatgggctgcaacaatgattccctggtgcagcagatatttaacgcggcgcagctggacaactatacccgaataggcttcgccccctcgtcctggat

SEQ ID NO: 11344 - DNA, 201 bp, Homo sapiens
agtgatgtcttcaccgttgtaattagctatgccatcatgtttctatatatttccctagccttggggcacatcaaaagctgtcgcaggcttctggtggattsgaaggtctcactaggcatcgcgggcatcttgatcgtgctgagctcggtggcttgctccttgggtgtcttcagctacattgggttgcccttgaccctcatt

SEQ ID NO: 11345 - DNA, 201 bp, Homo sapiens
gatgccagatgactcctacatggtggattatttcaaatccatcagtcagtacctgcatgcgggtccgcctgtgtactttgtcctggaggaagggcacgackacacttcttccaaggggcagaacatggtgtgcggcggcatgggctgcaacaatgattccctggtgcagcagatatttaacgcggcgcagctggacaacta

SEQ ID NO: 11346 - DNA, 201 bp, Homo sapiens
gatattggattggatcagtctctttcgatgccagatgactcctacatggtggattatttcaaatccatcagtcagtacctgcatgcgggtccgcctgtgtrctttgtcctggaggaagggcacgactacacttcttccaaggggcagaacatggtgtgcggcggcatgggctgcaacaatgattccctggtgcagcagata

SEQ ID NO: 11347 - DNA, 201 bp, Homo sapiens
aatgatacagagaagctccagagggcccaggcctgggaaaaagagtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 11348 - DNA, 201 bp, Homo sapiens
gtgagtctcttggggttagacattaaacgtcaagagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtgatagcaatatttgtgggtgttctg

SEQ ID NO: 11349 - DNA, 201 bp, Homo sapiens
caccaggttcttgacttacaaatagccatcgaaaacattactgcctcttatgacaatgagactgtgacacttcaagacatctgcttggcccctctttcacygtataacacgaactgcaccattttgagtgtgttaaattacttccagaacagccattccgtgctggaccacaagaaaggggacgacttctttgtgtatgcc

SEQ ID NO: 11350 - DNA, 201 bp, Homo sapiens
cgtccgaaaccctggctgtgtcattttcttctcgctggtcttcattactgcgtgttcgtcaggcctggtgtttgtccgggtcacaaccaatccagttgacytctggtcagcccccagcagccaggctcgcctggaaaaagagtactttgaccagcactttgggcctttcttccggacggagcagctcatcatccgggcccc

SEQ ID NO: 11351 - DNA, 201 bp, Homo sapiens
gtccgggtcacaaccaatccagttgacctctggtcagcccccagcagccaggctcgcctggaaaaagagtactttgaccagcactttgggcctttcttccrgacggagcagctcatcatccgggcccctctcactgacaaacacatttaccagccatacccttcgggagctgatgtaccctttggacctccgcttgacata

SEQ ID NO: 11352 - DNA, 201 bp, Homo sapiens
ttctgcgtccgaaaccctggctgtgtcattttcttctcgctggtcttcattactgcgtgttcgtcaggcctggtgtttgtccgggtcacaaccaatccagytgacctctggtcagcccccagcagccaggctcgcctggaaaaagagtactttgaccagcactttgggcctttcttccggacggagcagctcatcatccgg

SEQ ID NO: 11353 - DNA, 201 bp, Homo sapiens
actgaccagttctgcaatgcttcagtggttgaccctgcctgcgttcgctgcaggcctctgactccggaaggcaaacagaggcctcaggggggagacttcakgagattcctgcccatgttcctttcggataaccctaaccccaagtgtggcaaagggggacatgctgcctatagttctgcagttaacatcctccttggccat

SEQ ID NO: 11354 - DNA, 201 bp, Homo sapiens
gggcacgactacacttcttccaaggggcagaacatggtgtgcggcggcatgggctgcaacaatgattccctggtgcagcagatatttaacgcggcgcagcyggacaactatacccgaataggcttcgccccctcgtcctggatcgacgattatttcgactgggtgaagccacagtcgtcttgctgtcgagtggacaatatc

SEQ ID NO: 11355 - DNA, 201 bp, Homo sapiens
gatgaacgtcttcaaggggaaaccctggatcagcagctgggcagggtcctaggagaagtggctcccagtatgttcctgtcatccttttctgagactgtagmatttttcttaggagcattgtccgtgatgccagccgtgcacaccttctctctctttgcgggattggcagtcttcattgactttcttctgcagattacctgt

SEQ ID NO: 11356 - DNA, 201 bp, Homo sapiens
tgctgcatcggcaaggccaagttgaacaccggatggtgccaaccatcggttgtttggcagcagctttgaacgtagcgcctgtgaactcaggaatgcacagytgacttgggaagcagtattactagatctggaggcaaccacaggacactaaacttctcccagcctcttcaggaaagaaacctcattctttggcaagcagga

SEQ ID NO: 11357 - DNA, 201 bp, Homo sapiens
atattggattggatcagtctctttcgatgccagatgactcctacatggtggattatttcaaatccatcagtcagtacctgcatgcgggtccgcctgtgtastttgtcctggaggaagggcacgactacacttcttccaaggggcagaacatggtgtgcggcggcatgggctgcaacaatgattccctggtgcagcagatat

SEQ ID NO: 11358 - DNA, 201 bp, Homo sapiens
aactgcaccattttgagtgtgttaaattacttccagaacagccattccgtgctggaccacaagaaaggggacgacttctttgtgtatgccgattaccacaygcactttctgtactgcgtacgggctcctgcctctctgaatgatacaagtttgctccatgacccttgtctgggtacgtttggtggaccagtgttcccgtgg

SEQ ID NO: 11359 - DNA, 201 bp, Homo sapiens
cgctctgaagaaagcccgacttatagccagtaatgtcaccgaaaccatgggcattaacggcagtgcctaccgagtatttccttacagtgtgttttatgtcytctacgaacagtacctgaccatcattgacgacactatcttcaacctcggtgtgtccctgggcgcgatatttctggtgaccatggtcctcctgggctgtga

SEQ ID NO: 11360 - DNA, 201 bp, Homo sapiens
tgccaaatctcaaattttccagatattctacttcaggatgtatttggccatggtcttactgggagccactcacggattaatatttctccctgtcttactcrgttacatagggccatcagtaaataaagccaaaagttgtgccactgaagagcgatacaaaggaacagagcgcgaacggcttctaaatttctagccctctcg

SEQ ID NO: 11361 - DNA, 201 bp, Homo sapiens
gggcacatcaaaagctgtcgcaggcttctggtggattcgaaggtctcactaggcatcgcgggcatcttgatcgtgctgagctcggtggcttgctccttggktgtcttcagctacattgggttgcccttgaccctcattgtgattgaagtcatcccgttcctggtgctggctgttggagtggacaacatcttcattctggtg

SEQ ID NO: 11362 - DNA, 201 bp, Homo sapiens
ctattctccacttctgctaaaggactggatgagaccaattgtgatagcaatatttgtgggtgttctgtcattcagcatcgcagtcctgaacaaagtagatrttggattggatcagtctctttcgatgccagatgactcctacatggtggattatttcaaatccatcagtcagtacctgcatgcgggtccgcctgtgtactt

SEQ ID NO: 11363 - DNA, 201 bp, Homo sapiens
actacacttcttccaaggggcagaacatggtgtgcggcggcatgggctgcaacaatgattccctggtgcagcagatatttaacgcggcgcagctggacaaytatacccgaataggcttcgccccctcgtcctggatcgacgattatttcgactgggtgaagccacagtcgtcttgctgtcgagtggacaatatcactgacc

SEQ ID NO: 11364 - DNA, 201 bp, Homo sapiens
aacatcttcattctggtgcaggcctaccagagagatgaacgtcttcaaggggaaaccctggatcagcagctgggcagggtcctaggagaagtggctcccaktatgttcctgtcatccttttctgagactgtagcatttttcttaggagcattgtccgtgatgccagccgtgcacaccttctctctctttgcgggattggca

SEQ ID NO: 11365 - DNA, 201 bp, Homo sapiens
ctccttggccatggcaccagggtcggagccacgtacttcatgacctaccacaccgtgctgcagacctctgctgactttattgacgctctgaagaaagcccracttatagccagtaatgtcaccgaaaccatgggcattaacggcagtgcctaccgagtatttccttacagtgtgttttatgtcttctacgaacagtacctg

SEQ ID NO: 11366 - DNA, 201 bp, Homo sapiens
agtatgttcctgtcatccttttctgagactgtagcatttttcttaggagcattgtccgtgatgccagccgtgcacaccttctctctctttgcgggattggyagtcttcattgactttcttctgcagattacctgtttcgtgagtctcttggggttagacattaaacgtcaagagaaaaatcggctagacatcttttgctgt

SEQ ID NO: 11367 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggttcttgacttacaaatagccatcgaaaacattactgcctcttatgacaatgagactgtgacacttcaagacat

SEQ ID NO: 11368 - DNA, 201 bp, Homo sapiens
gggcccaggcctgggaaaaagagtttattaattttgtgaaaaactacaagaatcccaatctgaccatttccttcactgctgaacgaagtattgaagatgamctaaatcgtgaaagtgacagtgatgtcttcaccgttgtaattagctatgccatcatgtttctatatatttccctagccttggggcacatcaaaagctgtc

SEQ ID NO: 11369 - DNA, 201 bp, Homo sapiens
aaggcagccgcgtggagcgcgcggaagaggcacttgcccacatgggcagctccgtgttcagtggaatcacacttacaaaatttggagggattgtggtgttsgcttttgccaaatctcaaattttccagatattctacttcaggatgtatttggccatggtcttactgggagccactcacggattaatatttctccctgtct

SEQ ID NO: 11370 - DNA, 201 bp, Homo sapiens
gtgcaggaactctgtccaggattcttctttggcaatgtcagtctctgttgtgatgttcggcagcttcagacactaaaagacaacctgcagctgcctctacrgtttctgtccagatgtccatcctgtttttataacctactgaacctgttttgtgagctgacatgtagccctcgacagagtcagtttttgaatgttacagct

SEQ ID NO: 11371 - DNA, 201 bp, Homo sapiens
tgtgggaaggacgctgacgcctgtaatgccaccaactggattgaatacatgttcaataaggacaatggacaggcaccttttaccatcactcctgtgttttmagattttccagtccatgggatggagcccatgaacaatgccaccaaaggctgtgacgagtctgtggatgaggtcacagcaccatgtagctgccaagactgc

SEQ ID NO: 11372 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacgggctcctgcctctctgaatgatacaagtttgctccatgacccttgtctgggtacgtttggtggaccagtgttcccgtggctt

SEQ ID NO: 11373 - DNA, 201 bp, Homo sapiens
gttaaattacttccagaacagccattccgtgctggaccacaagaaaggggacgacttctttgtgtatgccgattaccacacgcactttctgtactgcgtaygggctcctgcctctctgaatgatacaagtttgctccatgacccttgtctgggtacgtttggtggaccagtgttcccgtggcttgtgttgggaggctatga

SEQ ID NO: 11374 - DNA, 201 bp, Homo sapiens
catgggatggagcccatgaacaatgccaccaaaggctgtgacgagtctgtggatgaggtcacagcaccatgtagctgccaagactgctctattgtctgtgkccccaagccccagcccccacctcctcctgctccctggacgatccttggcttggacgccatgtatgtcatcatgtggatcacctacatggcgtttttgctt

SEQ ID NO: 11375 - DNA, 201 bp, Homo sapiens
atatttgtgggtgttctgtcattcagcatcgcagtcctgaacaaagtagatattggattggatcagtctctttcgatgccagatgactcctacatggtggwttatttcaaatccatcagtcagtacctgcatgcgggtccgcctgtgtactttgtcctggaggaagggcacgactacacttcttccaaggggcagaacatg

SEQ ID NO: 11376 - DNA, 201 bp, Homo sapiens
cttgatcgtgctgagctcggtggcttgctccttgggtgtcttcagctacattgggttgcccttgaccctcattgtgattgaagtcatcccgttcctggtgstggctgttggagtggacaacatcttcattctggtgcaggcctaccagagagatgaacgtcttcaaggggaaaccctggatcagcagctgggcagggtcct

SEQ ID NO: 11377 - DNA, 201 bp, Homo sapiens
tggcttgctccttgggtgtcttcagctacattgggttgcccttgaccctcattgtgattgaagtcatcccgttcctggtgctggctgttggagtggacaayatcttcattctggtgcaggcctaccagagagatgaacgtcttcaaggggaaaccctggatcagcagctgggcagggtcctaggagaagtggctcccagta

SEQ ID NO: 11378 - DNA, 201 bp, Homo sapiens
ctatacccgaataggcttcgccccctcgtcctggatcgacgattatttcgactgggtgaagccacagtcgtcttgctgtcgagtggacaatatcactgacyagttctgcaatgcttcagtggttgaccctgcctgcgttcgctgcaggcctctgactccggaaggcaaacagaggcctcaggggggagacttcatgagatt

SEQ ID NO: 11379 - DNA, 201 bp, Homo sapiens
gtgtccctgggcgcgatatttctggtgaccatggtcctcctgggctgtgagctctggtctgcagtcatcatgtgtgccaccatcgccatggtcttggtcawcatgtttggagttatgtggctctggggcatcagtctgaacgctgtatccttggtcaacctggtgatgagctgtggcatctccgtggagttctgcagccac

SEQ ID NO: 11380 - DNA, 201 bp, Homo sapiens
cagcagatatttaacgcggcgcagctggacaactatacccgaataggcttcgccccctcgtcctggatcgacgattatttcgactgggtgaagccacagtygtcttgctgtcgagtggacaatatcactgaccagttctgcaatgcttcagtggttgaccctgcctgcgttcgctgcaggcctctgactccggaaggcaaa

SEQ ID NO: 11381 - DNA, 201 bp, Homo sapiens
gacgcctgtaatgccaccaactggattgaatacatgttcaataaggacaatggacaggcaccttttaccatcactcctgtgttttcagattttccagtccrtgggatggagcccatgaacaatgccaccaaaggctgtgacgagtctgtggatgaggtcacagcaccatgtagctgccaagactgctctattgtctgtggc

SEQ ID NO: 11382 - DNA, 201 bp, Homo sapiens
actaaaagacaacctgcagctgcctctacagtttctgtccagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 11383 - DNA, 201 bp, Homo sapiens
aatggacaggcaccttttaccatcactcctgtgttttcagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 11384 - DNA, 201 bp, Homo sapiens
gttctgcagccacataaccagagcgttcacggtgagcatgaaaggcagccgcgtggagcgcgcggaagaggcacttgcccacatgggcagctccgtgttcrgtggaatcacacttacaaaatttggagggattgtggtgttggcttttgccaaatctcaaattttccagatattctacttcaggatgtatttggccatggt

SEQ ID NO: 11385 - DNA, 201 bp, Homo sapiens
gaaaggcagccgcgtggagcgcgcggaagaggcacttgcccacatgggcagctccgtgttcagtggaatcacacttacaaaatttggagggattgtggtgktggcttttgccaaatctcaaattttccagatattctacttcaggatgtatttggccatggtcttactgggagccactcacggattaatatttctccctgt

SEQ ID NO: 11386 - DNA, 201 bp, Homo sapiens
aatttggagggattgtggtgttggcttttgccaaatctcaaattttccagatattctacttcaggatgtatttggccatggtcttactgggagccactcayggattaatatttctccctgtcttactcagttacatagggccatcagtaaataaagccaaaagttgtgccactgaagagcgatacaaaggaacagagcgcg

SEQ ID NO: 11387 - DNA, 201 bp, Homo sapiens
gggcatcagtctgaacgctgtatccttggtcaacctggtgatgagctgtggcatctccgtggagttctgcagccacataaccagagcgttcacggtgagcrtgaaaggcagccgcgtggagcgcgcggaagaggcacttgcccacatgggcagctccgtgttcagtggaatcacacttacaaaatttggagggattgtggt

SEQ ID NO: 11388 - DNA, 201 bp, Homo sapiens
gtcttcaaggggaaaccctggatcagcagctgggcagggtcctaggagaagtggctcccagtatgttcctgtcatccttttctgagactgtagcatttttyttaggagcattgtccgtgatgccagccgtgcacaccttctctctctttgcgggattggcagtcttcattgactttcttctgcagattacctgtttcgtga

SEQ ID NO: 11389 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactatacccgaataggcttcgccccctcgtcctggatcga

SEQ ID NO: 11390 - DNA, 201 bp, Homo sapiens
acaaagtagatattggattggatcagtctctttcgatgccagatgactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 11391 - DNA, 201 bp, Homo sapiens
gatcgacgattatttcgactgggtgaagccacagtcgtcttgctgtcgagtggacaatatcactgaccagttctgcaatgcttcagtggttgaccctgccygcgttcgctgcaggcctctgactccggaaggcaaacagaggcctcaggggggagacttcatgagattcctgcccatgttcctttcggataaccctaaccc

SEQ ID NO: 11392 - DNA, 201 bp, Homo sapiens
tggtgttggcttttgccaaatctcaaattttccagatattctacttcaggatgtatttggccatggtcttactgggagccactcacggattaatatttctycctgtcttactcagttacatagggccatcagtaaataaagccaaaagttgtgccactgaagagcgatacaaaggaacagagcgcgaacggcttctaaatt

SEQ ID NO: 11393 - DNA, 201 bp, Homo sapiens
gtcttactgggagccactcacggattaatatttctccctgtcttactcagttacatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 11394 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacagaaaacggtattttgtctccgagtacactcccatc

SEQ ID NO: 11395 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatgagctgtggcatctccgtggagttctgcagccacataaccagagcgttcacggtgagcatgaaaggcagccgcgtggagcgcgcggaagag

SEQ ID NO: 11396 - DNA, 201 bp, Homo sapiens
gttttcagattttccagtccatgggatggagcccatgaacaatgccaccaaaggctgtgacgagtctgtggatgaggtcacagcaccatgtagctgccaavactgctctattgtctgtggccccaagccccagcccccacctcctcctgctccctggacgatccttggcttggacgccatgtatgtcatcatgtggatcac

SEQ ID NO: 11397 - DNA, 201 bp, Homo sapiens
ctgaagaaagcccgacttatagccagtaatgtcaccgaaaccatgggcattaacggcagtgcctaccgagtatttccttacagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 11398 - DNA, 201 bp, Homo sapiens
ttacaatactacgtcggacagagttttgccaatgcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 11399 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacagtgtgttttatgtcttctacgaacagtacctgaccatc

SEQ ID NO: 11400 - DNA, 201 bp, Homo sapiens
actccggaaggcaaacagaggcctcaggggggagacttcatgagattcctgcccatgttcctttcggataaccctaaccccaagtgtggcaaagggggacrtgctgcctatagttctgcagttaacatcctccttggccatggcaccagggtcggagccacgtacttcatgacctaccacaccgtgctgcagacctctgct

SEQ ID NO: 11401 - DNA, 201 bp, Homo sapiens
ctttcggataaccctaaccccaagtgtggcaaagggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 11402 - DNA, 201 bp, Homo sapiens
agccgtgcacaccttctctctctttgcgggattggcagtcttcattgactttcttctgcagattacctgtttcgtgagtctcttggggttagacattaaabgtcaagagaaaaatcggctagacatcttttgctgtgtcagaggtgctgaagatggaacaagcgtccaggcctcagagagctgtttgtttcgcttcttcaa

SEQ ID NO: 11403 - DNA, 201 bp, Homo sapiens
gtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagttgacctctggtcagcccccagcagccaggctcgcctgg

SEQ ID NO: 11404 - DNA, 201 bp, Homo sapiens
cttccagaacagccattccgtgctggaccacaagaaaggggacgacttctttgtgtatgccgattaccacacgcactttctgtactgcgtacgggctcctkcctctctgaatgatacaagtttgctccatgacccttgtctgggtacgtttggtggaccagtgttcccgtggcttgtgttgggaggctatgatgatcaaaa

SEQ ID NO: 11405 - DNA, 201 bp, Homo sapiens
cagtgtggtgctacagaaaacggtattttgtctccgagtacactcccatcgatagcaatatagctttttctgttaatgcaagtgacaaaggagaggcgtcytgctgtgaccctgtcagcgcagcatttgagggctgcttgaggcggctgttcacacgctgggggtctttctgcgtccgaaaccctggctgtgtcattttct

SEQ ID NO: 11406 - DNA, 201 bp, Homo sapiens
agtggacaatatcactgaccagttctgcaatgcttcagtggttgaccctgcctgcgttcgctgcaggcctctgactccggaaggcaaacagaggcctcagbggggagacttcatgagattcctgcccatgttcctttcggataaccctaaccccaagtgtggcaaagggggacatgctgcctatagttctgcagttaacat

SEQ ID NO: 11407 - DNA, 201 bp, Homo sapiens
atatttaacgcggcgcagctggacaactatacccgaataggcttcgccccctcgtcctggatcgacgattatttcgactgggtgaagccacagtcgtcttrctgtcgagtggacaatatcactgaccagttctgcaatgcttcagtggttgaccctgcctgcgttcgctgcaggcctctgactccggaaggcaaacagagg

SEQ ID NO: 11408 - DNA, 201 bp, Homo sapiens
cgattatttcgactgggtgaagccacagtcgtcttgctgtcgagtggacaatatcactgaccagttctgcaatgcttcagtggttgaccctgcctgcgttygctgcaggcctctgactccggaaggcaaacagaggcctcaggggggagacttcatgagattcctgcccatgttcctttcggataaccctaaccccaagtg

SEQ ID NO: 11409 - DNA, 201 bp, Homo sapiens
caacaatgattccctggtgcagcagatatttaacgcggcgcagctggacaactatacccgaataggcttcgccccctcgtcctggatcgacgattatttcractgggtgaagccacagtcgtcttgctgtcgagtggacaatatcactgaccagttctgcaatgcttcagtggttgaccctgcctgcgttcgctgcaggcc

SEQ ID NO: 11410 - DNA, 201 bp, Homo sapiens
tgtccgggtcacaaccaatccagttgacctctggtcagcccccagcagccaggctcgcctggaaaaagagtactttgaccagcactttgggcctttcttcyggacggagcagctcatcatccgggcccctctcactgacaaacacatttaccagccatacccttcgggagctgatgtaccctttggacctccgcttgacat

SEQ ID NO: 11411 - DNA, 201 bp, Homo sapiens
ctaccagagagatgaacgtcttcaaggggaaaccctggatcagcagctgggcagggtcctaggagaagtggctcccagtatgttcctgtcatccttttctragactgtagcatttttcttaggagcattgtccgtgatgccagccgtgcacaccttctctctctttgcgggattggcagtcttcattgactttcttctgca

SEQ ID NO: 11412 - DNA, 201 bp, Homo sapiens
ctccaggatttgtgtgctgttgccgaatactcaggacggacctgaattctgattttataccagtctcttcaaaaacttctcgaaccgctgtgtctcctacktaaaaaaagagatgtacaaatcaataataattacacttttagaaactgtatcatcaaagattttcagttaaagtagcattatgtaaaggctcaaaacatt

SEQ ID NO: 11413 - DNA, 201 bp, Homo sapiens
attgttggctaaatagaataggggacatgcatattaaggaaaaggtcatggagaaataatattggtatcaaacaaatacattgatttgtcatgatacacaytgaatttgatccaatagtttaaggaataggtaggaaaatttggtttctatttttcgatttcctgtaaatcagtgacataaataattcttagcttatttta

SEQ ID NO: 11414 - DNA, 201 bp, Homo sapiens
tgaaaataaattatggggatcctatttagctcttagtaccactaatcaaaagttcggcatgtagctcatgatctatgctgtttctatgtcgtggaagcacyggatgggggtagtgagcaaatctgccctgctcagcagtcaccatagcagctgactgaaaatcagcactgcctgagtagttttgatcagtttaacttgaat

SEQ ID NO: 11415 - DNA, 180 bp, Homo sapiens
cggccccagaaaacccgagcgagtagggggcggcgcgcaggagggaggagaactgggggcgcgggaggctggtgggtgtsgggggtggagatgtagaagatgtgacgccgcggcccggcgggtgccagattagcggacgcggtgcccgcggttgcaacgggatcccgggcgctgcagctt

SEQ ID NO: 11416 - DNA, 201 bp, Homo sapiens
aatgccttcatatagacatagtctttcagacctctactgtcagttttcatttctagctgctttcagggttttatgaattttcaggcaaagctttaatttayactaagcttaggaagtatggctaatgccaacggcagtttttttcttcttaattccacatgactgaggcatatatgatctctgggtaggtgagttgttgtg

SEQ ID NO: 11417 - DNA, 201 bp, Homo sapiens
gctcagtaagttgtgttaggggattatttctcagttgagactttcttatatgacattttactatgttttgacttcctgactattaaaaataaatagtagawacaattttcataaagtgaagaattatataatcactgctttataactgactttattatatttatttcaaagttcatttaaaggctactattcatcctctgt

SEQ ID NO: 11418 - DNA, 201 bp, Homo sapiens
ttcttcctggcaaaaatttatggtgaatgaatatggctttaggcggcagatgatatacatatctgacttcccaaaagctccaggatttgtgtgctgttgcygaatactcaggacggacctgaattctgattttataccagtctcttcaaaaacttctcgaaccgctgtgtctcctacgtaaaaaaagagatgtacaaatca

SEQ ID NO: 11419 - DNA, 201 bp, Homo sapiens
tttatatttccttgtcttaaatactgagctcagtaagttgtgttaggggattatttctcagttgagactttcttatatgacattttactatgttttgactwcctgactattaaaaataaatagtagatacaattttcataaagtgaagaattatataatcactgctttataactgactttattatatttatttcaaagttc

SEQ ID NO: 11420 - DNA, 201 bp, Homo sapiens
aggaatttgttttctcatagtttaattccaacaacaatattagtcgtatccaaaataacctttaatgctaaactttactgatgtatatccaaagcttctcmttttcagacagattaatccagaagcagtcataaacagaagaataggtggtatgttcctaatgatattatttctactaatggaataaactgtaatattaga

SEQ ID NO: 11421 - DNA, 201 bp, Homo sapiens
tatatttggcttggaaatgtgtttttcttcaattacatctacaagtaagtacagctgaaattcagaggacccataagagttcacatgaaaaaaatcaattyatttgaaaaggcaagatgcaggagagaggaagccttgcaaacctgcagactgctttttgcccaatatagattgggtaaggctgcaaaacataagcttaat

SEQ ID NO: 11422 - DNA, 201 bp, Homo sapiens
gactgtcttacccatcccctggatatgctcttgttttttccctctaatagctatggaaagatgcatagaaagagtataatgttttaaaacataaggcattygtctgccatttttcaattacatgctgacttcccttacaattgagatttgcccataggttaaacatggttagaaacaactgaaagcataaaagaaaaatct

SEQ ID NO: 11423 - DNA, 201 bp, Homo sapiens
taatggccacatctaatctcatttcacatgaaagaagaagtatattttagaaatttgttaatgagagtaaaagaaaataaatgtgtatagctcagtttggrtaattggtcaaacaattttttatccagtagtaaaatatgtaaccattgtcccagtaaagaaaaataacaaaagttgtaaaatgtatattctcccttttat

SEQ ID NO: 11424 - DNA, 201 bp, Homo sapiens
tataatgggaaataatctgcagaatgtgggttttcctggtgtttccctctgactctagtgcactgatgatctctgataaggctcagctgctttatagttckctggctaatgcagcagatactcttcctgccagtggtaatacgattttttaagaaggcagtttgtcaattttaatcttgtggatacctttatactcttagg

SEQ ID NO: 11425 - DNA, 201 bp, Homo sapiens
gtttgatcagttttcaagaaacttggaatataaataattttataattcaacaaaggttttcacattttataaggttgatttttcaattaaatgcaaatttrtgtggcaggatttttattgccattaacatatttttgtggctgctttttctacacatccagatggtccctctaactgggctttctctaattttgtgatgtt

SEQ ID NO: 11426 - DNA, 201 bp, Homo sapiens
attcagcttcatcattaagaatatcttttgttttatgttgagttagaaatgccttcatatagacatagtctttcagacctctactgtcagttttcatttcyagctgctttcagggttttatgaattttcaggcaaagctttaatttacactaagcttaggaagtatggctaatgccaacggcagtttttttcttcttaatt

SEQ ID NO: 11427 - DNA, 201 bp, Homo sapiens
tacacaccaatatcttcttcaggctctgacaggcctcctggaaacttccacatatttttcaactgcagtataaagtcagaaaataaagttaacataacttycactaacacacacatatgtagatttcacaaaatccacctataattggtcaaagtggttgagaatatattttttagtaattgcatgcaaaatttttctagc

SEQ ID NO: 11428 - DNA, 201 bp, Homo sapiens
gccagattagcggacgcggtgcccgcggttgcaacgggatcccgggcgctgcagcttgggaggcggctctccccaggcggcgtccgcggagacacccatcygtgaaccccaggtcccgggccgccggctcgccgcgcaccaggggccggcggacagaagagcggccgagcggctcgaggctgggggaccgcgggcgcggcc

SEQ ID NO: 11429 - DNA, 201 bp, Homo sapiens
aatagaataggggacatgcatattaaggaaaaggtcatggagaaataatattggtatcaaacaaatacattgatttgtcatgatacacactgaatttgatscaatagtttaaggaataggtaggaaaatttggtttctatttttcgatttcctgtaaatcagtgacataaataattcttagcttattttatatttccttgt

SEQ ID NO: 11430 - DNA, 201 bp, Homo sapiens
ttagatttgctgccaattgctcacttgcatctaagttatatccttctggatttaagaaattattatataaaagaaaatgagacagaaagtctacaaattcygaatgcaaaaacccttcaccttgtttttcacccaactagtttattcgctatccaagtgaacatatcagttaatactttagggtgcttacaactgactaat

SEQ ID NO: 11431 - DNA, 201 bp, Homo sapiens
aacatatcagttaatactttagggtgcttacaactgactaatattaaattgaatgatgacaactgtcaagttttcattaaatttttatcagaactcaccaraggttcaaccttactgaattttaccctcaaccacatagaaacgacttggaaatgcctggtcagagtctttcaatttctttggcccaaacctgtggaatat

SEQ ID NO: 11432 - DNA, 201 bp, Homo sapiens
caagtccatctttgttttgtctcccaactttgtccagagtgagtggtgccattacgaactctattttgcccatcacaatctctttcatgaaggatctaatracttaatcctcatcttactggaacccattccacagaacagcattcccaacaagtaccacaagctgaaggctctcatgacgcagcggacttatttgcagtg

SEQ ID NO: 11433 - DNA, 140 bp, Homo sapiens
tagaatttggactcatatcaagatgctctgaagaagaacraccctttaggatagccactgcaacatcatgaccaaagacaaagaacctattgttaaaagcttccattttgtttgccttatgatcataatagttggaacca

SEQ ID NO: 11434 - DNA, 201 bp, Homo sapiens
ctctttcatgaaggatctaataacttaatcctcatcttactggaacccattccacagaacagcattcccaacaagtaccacaagctgaaggctctcatgaygcagcggacttatttgcagtggcccaaggagaaaagcaaacgtgggctcttttgggctaacattagagccgcttttaatatgaaattaacactagtcact

SEQ ID NO: 11435 - DNA, 201 bp, Homo sapiens
atgagctttctatcagagttgacagttttgagactttcccataacagaatccagctacttgatttaagtgttttcaagttcaaccaggatttagaatattkggatttatctcataatcagttgcaaaagatatcctgccatcctattgtgagtttcaggcatttagatctctcattcaatgatttcaaggccctgcccatc

SEQ ID NO: 11436 - DNA, 201 bp, Homo sapiens
atcagttaatactttagggtgcttacaactgactaatattaaattgaatgatgacaactgtcaagttttcattaaatttttatcagaactcaccagaggtycaaccttactgaattttaccctcaaccacatagaaacgacttggaaatgcctggtcagagtctttcaatttctttggcccaaacctgtggaatatctcaa

SEQ ID NO: 11437 - DNA, 201 bp, Homo sapiens
caagctgaaggctctcatgacgcagcggacttatttgcagtggcccaaggagaaaagcaaacgtgggctcttttgggctaacattagagccgcttttaatrtgaaattaacactagtcactgaaaacaatgatgtgaaatcttaaaaaaatttaggaaattcaacttaagaaaccattatttacttggatgatggtgaata

SEQ ID NO: 11438 - DNA, 201 bp, Homo sapiens
gactttcacatgtctgaattatcctgcaacataactctgctgatcgtcaccatcggtgccaccatgctggtgttggctgtgactgtgacctccctctgcakctacttggatctgccctggtatctcaggatggtgtgccagtggacccagactcggcgcagggccaggaacatacccttagaagaactccaaagaaacctc

SEQ ID NO: 11439 - DNA, 201 bp, Homo sapiens
tgcttacaactgactaatattaaattgaatgatgacaactgtcaagttttcattaaatttttatcagaactcaccagaggttcaaccttactgaattttaycctcaaccacatagaaacgacttggaaatgcctggtcagagtctttcaatttctttggcccaaacctgtggaatatctcaatatttacaatttaacaata

SEQ ID NO: 11440 - DNA, 201 bp, Homo sapiens
tatcacgaaccaagtttttctgttttcacagacagctttgtacaccgtgttttctgagatgaacattatgatgttaaccatttcagatacaccttttatayacatgctgtgtcctcatgcaccaagcacattcaagtttttgaactttacccagaacgttttcacagatagtatttttgaaaaatgttccacgttagttaa

SEQ ID NO: 11441 - DNA, 201 bp, Homo sapiens
tccaatgtacctgtgagctaagagaatttgtcaaaaatatagaccaagtatcaagtgaagtgttagagggctggcctgattcttataagtgtgactacccrgaaagttatagaggaagcccactaaaggactttcacatgtctgaattatcctgcaacataactctgctgatcgtcaccatcggtgccaccatgctggtgt

SEQ ID NO: 11442 - DNA, 201 bp, Homo sapiens
tataagtgtgactacccagaaagttatagaggaagcccactaaaggactttcacatgtctgaattatcctgcaacataactctgctgatcgtcaccatcgktgccaccatgctggtgttggctgtgactgtgacctccctctgcatctacttggatctgccctggtatctcaggatggtgtgccagtggacccagactcgg

SEQ ID NO: 11443 - DNA, 201 bp, Homo sapiens
gattaaaagaccttttcaaagtaggtctcatgacgaaggatatgccttctttggaaatactggatgttagctggaattctttggaatctggtagacataargaaaactgcacttgggttgagagtatagtggtgttaaatttgtcttcaaatatgcttactgactctgttttcagatgtttacctcccaggatcaaggtac

SEQ ID NO: 11444 - DNA, 201 bp, Homo sapiens
tcaatgttgctttcaattctttaactgaccttcctggatgtggcagctttagcagcctttctgtattgatcattgatcacaattcagtttcccacccatcrgctgatttcttccagagctgccagaagatgaggtcaataaaagcaggggacaatccattccaatgtacctgtgagctaagagaatttgtcaaaaatatag

SEQ ID NO: 11445 - DNA, 201 bp, Homo sapiens
tgatcattgatcacaattcagtttcccacccatcggctgatttcttccagagctgccagaagatgaggtcaataaaagcaggggacaatccattccaatgyacctgtgagctaagagaatttgtcaaaaatatagaccaagtatcaagtgaagtgttagagggctggcctgattcttataagtgtgactacccagaaagtt

SEQ ID NO: 11446 - DNA, 201 bp, Homo sapiens
tgaagaagattttacttattctaaaacgacattgaaagcattgacaatagaacatatcacgaaccaagtttttctgttttcacagacagctttgtacaccrtgttttctgagatgaacattatgatgttaaccatttcagatacaccttttatacacatgctgtgtcctcatgcaccaagcacattcaagtttttgaactt

SEQ ID NO: 11447 - DNA, 201 bp, Homo sapiens
ggtgttaaatttgtcttcaaatatgcttactgactctgttttcagatgtttacctcccaggatcaaggtacttgatcttcacagcaataaaataaagagcrttcctaaacaagtcgtaaaactggaagctttgcaagaactcaatgttgctttcaattctttaactgaccttcctggatgtggcagctttagcagcctttc

SEQ ID NO: 11448 - DNA, 201 bp, Homo sapiens
tgccctggtatctcaggatggtgtgccagtggacccagactcggcgcagggccaggaacatacccttagaagaactccaaagaaacctccagtttcatgcktttatttcatatagtgaacatgattctgcctgggtgaaaagtgaattggtaccttacctagaaaaagaagatatacagatttgtcttcatgagagaaact

SEQ ID NO: 11449 - DNA, 201 bp, Homo sapiens
agaatccagctacttgatttaagtgttttcaagttcaaccaggatttagaatatttggatttatctcataatcagttgcaaaagatatcctgccatcctaytgtgagtttcaggcatttagatctctcattcaatgatttcaaggccctgcccatctgtaaggaatttggcaacttatcacaactgaatttcttgggattg

SEQ ID NO: 11450 - DNA, 201 bp, Homo sapiens
tatgaaattaacactagtcactgaaaacaatgatgtgaaatcttaaaaaaatttaggaaattcaacttaagaaaccattatttacttggatgatggtgaayagtacagtcgtaagtaactgtctggaggtgcctccattatcctcatgccttcaggaaagacttaacaaaaacaatgtttcatctggggaactgagctagg

SEQ ID NO: 11451 - DNA, 201 bp, Homo sapiens
tactgactctgttttcagatgtttacctcccaggatcaaggtacttgatcttcacagcaataaaataaagagcgttcctaaacaagtcgtaaaactggaarctttgcaagaactcaatgttgctttcaattctttaactgaccttcctggatgtggcagctttagcagcctttctgtattgatcattgatcacaattcagt

SEQ ID NO: 11452 - DNA, 201 bp, Homo sapiens
ataaagagcgttcctaaacaagtcgtaaaactggaagctttgcaagaactcaatgttgctttcaattctttaactgaccttcctggatgtggcagctttascagcctttctgtattgatcattgatcacaattcagtttcccacccatcggctgatttcttccagagctgccagaagatgaggtcaataaaagcaggggac

SEQ ID NO: 11453 - DNA, 201 bp, Homo sapiens
aaagtaggtctcatgacgaaggatatgccttctttggaaatactggatgttagctggaattctttggaatctggtagacataaagaaaactgcacttgggytgagagtatagtggtgttaaatttgtcttcaaatatgcttactgactctgttttcagatgtttacctcccaggatcaaggtacttgatcttcacagcaat

SEQ ID NO: 11454 - DNA, 201 bp, Homo sapiens
tttctgagatgaacattatgatgttaaccatttcagatacaccttttatacacatgctgtgtcctcatgcaccaagcacattcaagtttttgaactttacscagaacgttttcacagatagtatttttgaaaaatgttccacgttagttaaattggagacacttatcttacaaaagaatggattaaaagaccttttcaaag

SEQ ID NO: 11455 - DNA, 201 bp, Homo sapiens
ttaccctcaaccacatagaaacgacttggaaatgcctggtcagagtctttcaatttctttggcccaaacctgtggaatatctcaatatttacaatttaacrataattgaaagcattcgtgaagaagattttacttattctaaaacgacattgaaagcattgacaatagaacatatcacgaaccaagtttttctgttttcac

SEQ ID NO: 11456 - DNA, 201 bp, Homo sapiens
gaatgatgagcactgcttgaagaaaaagcacgcattgtgttacacagcctcctgccaggacatgtcctgcagcaaacaaggagagtgcctcgagaccatcrggaactacacctgctcctgttaccctggattctatgggccagaatgtgaatacgtgagagagtgtggagaacttgagctccctcaacacgtgctcatgaa

SEQ ID NO: 11457 - DNA, 201 bp, Homo sapiens
ctcgatcgggacgctggacagactccccaccaatgtgtgaagccatcaagtgcccagaactctttgccccagagcagggcagcctggattgttctgacacycgtggagaattcaatgttggctccacctgccatttctcttgtgacaacggctttaagctggaggggcccaataatgtggaatgcacaacttctggaagat

SEQ ID NO: 11458 - DNA, 201 bp, Homo sapiens
atgttggctccacctgccatttctcttgtgacaacggctttaagctggaggggcccaataatgtggaatgcacaacttctggaagatggtcagctactccrccaacctgcaaaggcatagcatcacttcctactccaggggtgcaatgtccagccctcaccactcctgggcagggaaccatgtactgtaggcatcatccgg

SEQ ID NO: 11459 - DNA, 201 bp, Homo sapiens
taagctggaggggcccaataatgtggaatgcacaacttctggaagatggtcagctactccaccaacctgcaaaggcatagcatcacttcctactccagggktgcaatgtccagccctcaccactcctgggcagggaaccatgtactgtaggcatcatccgggaacctttggttttaataccacttgttactttggctgcaa

SEQ ID NO: 11460 - DNA, 201 bp, Homo sapiens
agtgcccagaactctttgccccagagcagggcagcctggattgttctgacactcgtggagaattcaatgttggctccacctgccatttctcttgtgacaayggctttaagctggaggggcccaataatgtggaatgcacaacttctggaagatggtcagctactccaccaacctgcaaaggcatagcatcacttcctactc

SEQ ID NO: 11461 - DNA, 201 bp, Homo sapiens
acctgcaaaggcatagcatcacttcctactccaggggtgcaatgtccagccctcaccactcctgggcagggaaccatgtactgtaggcatcatccgggaamctttggttttaataccacttgttactttggctgcaacgctggattcacactcataggagacagcactctcagctgcagaccttcaggacaatggacagca

SEQ ID NO: 11462 - DNA, 201 bp, Homo sapiens
catcaagtgcccagaactctttgccccagagcagggcagcctggattgttctgacactcgtggagaattcaatgttggctccacctgccatttctcttgtracaacggctttaagctggaggggcccaataatgtggaatgcacaacttctggaagatggtcagctactccaccaacctgcaaaggcatagcatcacttcc

SEQ ID NO: 11463 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaagatgatgggaaatgccccttgaatcctcacagccacctaggaacatatggagtttttacaaacgctgcatttgacccgag

SEQ ID NO: 11464 - DNA, 201 bp, Homo sapiens
gcctttaggtaccagtcagtctgcagcttcacctgcaatgaaggcttgctcctggtgggagcaagtgtgctacagtgcttggctactggaaactggaattytgttcctccagaatgccaagccattccctgcacacctttgctaagccctcagaatggaacaatgacctgtgttcaacctcttggaagttccagttataaa

SEQ ID NO: 11465 - DNA, 201 bp, Homo sapiens
tgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgaggctatttcgtgtgagccgctggagagtcctgtccacggaagcatgga

SEQ ID NO: 11466 - DNA, 201 bp, Homo sapiens
gtgcaatgtccagccctcaccactcctgggcagggaaccatgtactgtaggcatcatccgggaacctttggttttaataccacttgttactttggctgcarcgctggattcacactcataggagacagcactctcagctgcagaccttcaggacaatggacagcagtaactccagcatgcagagctgtgaaatgctcagaa

SEQ ID NO: 11467 - DNA, 201 bp, Homo sapiens
ttagttggaccggaagtggtgcaatgcacagcctcgggggtatggacagccccagccccagtgtgtaaagctgtgcagtgtcagcacctggaagcccccartgaaggaaccatggactgtgttcatccgctcactgcttttgcctatggctccagctgtaaatttgagtgccagcccggctacagagtgaggggcttggac

SEQ ID NO: 11468 - DNA, 201 bp, Homo sapiens
aagctggaatgcttggcttctggaatctggacaaataagcctccacagtgtttagctgcccagtgcccacccctgaagattcctgaacgaggaaacatgayctgccttcattctgcaaaagcattccagcatcagtctagctgcagcttcagttgtgaagagggatttgcattagttggaccggaagtggtgcaatgcaca

SEQ ID NO: 11469 - DNA, 201 bp, Homo sapiens
caatgtgtgaagccatcaagtgcccagaactctttgccccagagcagggcagcctggattgttctgacactcgtggagaattcaatgttggctccacctgycatttctcttgtgacaacggctttaagctggaggggcccaataatgtggaatgcacaacttctggaagatggtcagctactccaccaacctgcaaaggca

SEQ ID NO: 11470 - DNA, 201 bp, Homo sapiens
ctttgcttcagtgccctgatctctgaactaacaaaccagaaagaagtggcagcatggacttatcattacagcacaaaagcatactcatggaatatttcccrtaaatactgccagaatcgctacacagacttagtggccatccagaataaaaatgaaattgattacctcaataaggtcctaccctactacagctcctactac

SEQ ID NO: 11471 - DNA, 201 bp, Homo sapiens
cctgctcctgttaccctggattctatgggccagaatgtgaatacgtgagagagtgtggagaacttgagctccctcaacacgtgctcatgaactgcagccaycctctgggaaacttctcttttaactcgcagtgcagcttccactgcactgacgggtaccaagtaaatgggcccagcaagctggaatgcttggcttctggaa

SEQ ID NO: 11472 - DNA, 201 bp, Homo sapiens
tgtttcctgagtttgggattgtggtacaatctcaaattctcaacctaccaccccttcctgtcccacctcttctcttcctgtaacacaagccacagaagccwggagcaaatgtttctgcagtagtctctgtgctttgactcacctgttacttgaaataccagtgaaccaaagagactggagcatctgactcacaagaagacc

SEQ ID NO: 11473 - DNA, 201 bp, Homo sapiens
caccaatgtgtgaagccatcaagtgcccagaactctttgccccagagcagggcagcctggattgttctgacactcgtggagaattcaatgttggctccacytgccatttctcttgtgacaacggctttaagctggaggggcccaataatgtggaatgcacaacttctggaagatggtcagctactccaccaacctgcaaag

SEQ ID NO: 11474 - DNA, 201 bp, Homo sapiens
tccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaagccatcaagtgcccagaact

SEQ ID NO: 11475 - DNA, 201 bp, Homo sapiens
gccgatatagttcggtgtgataacttgggacagtggacagcaccagccccagtctgtcaagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacag

SEQ ID NO: 11476 - DNA, 201 bp, Homo sapiens
tgccatttctcttgtgacaacggctttaagctggaggggcccaataatgtggaatgcacaacttctggaagatggtcagctactccaccaacctgcaaagkcatagcatcacttcctactccaggggtgcaatgtccagccctcaccactcctgggcagggaaccatgtactgtaggcatcatccgggaacctttggtttt

SEQ ID NO: 11477 - DNA, 201 bp, Homo sapiens
ttctgacactcgtggagaattcaatgttggctccacctgccatttctcttgtgacaacggctttaagctggaggggcccaataatgtggaatgcacaactkctggaagatggtcagctactccaccaacctgcaaaggcatagcatcacttcctactccaggggtgcaatgtccagccctcaccactcctgggcagggaac

SEQ ID NO: 11478 - DNA, 201 bp, Homo sapiens
caacctgcaaaggcatagcatcacttcctactccaggggtgcaatgtccagccctcaccactcctgggcagggaaccatgtactgtaggcatcatccgggracctttggttttaataccacttgttactttggctgcaacgctggattcacactcataggagacagcactctcagctgcagaccttcaggacaatggacag

SEQ ID NO: 11479 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaagctgtgcagtgtcagcacctggaagcccccagtgaaggaacc

SEQ ID NO: 11480 - DNA, 201 bp, Homo sapiens
cgagaccatcgggaactacacctgctcctgttaccctggattctatgggccagaatgtgaatacgtgagagagtgtggagaacttgagctccctcaacacrtgctcatgaactgcagccaccctctgggaaacttctcttttaactcgcagtgcagcttccactgcactgacgggtaccaagtaaatgggcccagcaagct

SEQ ID NO: 11481 - DNA, 201 bp, Homo sapiens
tttgagtgccagcccggctacagagtgaggggcttggacatgctccgctgcattgactctggacactggtctgcacccttgccaacctgtgaggctatttygtgtgagccgctggagagtcctgtccacggaagcatggattgctctccatccttgagagcgtttcagtatgacaccaactgtagcttccgctgtgctgaa

SEQ ID NO: 11482 - DNA, 138 bp, Homo sapiens
gatggcaccagaggctgcagaaggccaagaatcaagctagaaggccacatgtcaccgtggaccttcctgccaccagtcactgtccctcaaatgacccaaasaccaatattcaaatgcgtaattaaaagaattttcccc

SEQ ID NO: 11483 - DNA, 201 bp, Homo sapiens
ccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacagcctcctgccaggacatgtcctgcagcaaacaaggag

SEQ ID NO: 11484 - DNA, 201 bp, Homo sapiens
gtgagagagtgtggagaacttgagctccctcaacacgtgctcatgaactgcagccaccctctgggaaacttctcttttaactcgcagtgcagcttccactkcactgacgggtaccaagtaaatgggcccagcaagctggaatgcttggcttctggaatctggacaaataagcctccacagtgtttagctgcccagtgccca

SEQ ID NO: 11485 - DNA, 201 bp, Homo sapiens; identical to SEQ ID NO: 11456

SEQ ID NO: 11486 - DNA, 201 bp, Homo sapiens; identical to SEQ ID NO: 11457

SEQ ID NO: 11487 - DNA, 201 bp, Homo sapiens; identical to SEQ ID NO: 11458

SEQ ID NO: 11488 - DNA, 201 bp, Homo sapiens; identical to SEQ ID NO: 11459

SEQ ID NO: 11489 - DNA, 201 bp, Homo sapiens; identical to SEQ ID NO: 11460

SEQ ID NO: 11490 - DNA, 201 bp, Homo sapiens; identical to SEQ ID NO: 11461

SEQ ID NO: 11491 - DNA, 201 bp, Homo sapiens; identical to SEQ ID NO: 11462

SEQ ID NO: 11492 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaagcaggaccattgactatccaggaagccctgacttactttggtggagcggtggcttctacgataggtctgataatgggtgg

SEQ ID NO: 11493 - DNA, 201 bp, Homo sapiens; identical to SEQ ID NO: 11464

SEQ ID NO: 11494 - DNA, 201 bp, Homo sapiens; identical to SEQ ID NO: 11466

SEQ ID NO: 11495 - DNA, 201 bp, Homo sapiens; identical to SEQ ID NO: 11468

SEQ ID NO: 11496 - DNA, 201 bp, Homo sapiens; identical to SEQ ID NO: 11469

SEQ ID NO: 11497 - DNA, 201 bp, Homo sapiens; identical to SEQ ID NO: 11470

SEQ ID NO: 11498 - DNA, 201 bp, Homo sapiens; identical to SEQ ID NO: 11471

SEQ ID NO: 11499 - DNA, 201 bp, Homo sapiens; identical to SEQ ID NO: 11472

SEQ ID NO: 11500 - DNA, 201 bp, Homo sapiens; identical to SEQ ID NO: 11473

SEQ ID NO: 11501 - DNA, 201 bp, Homo sapiens; identical to SEQ ID NO: 11474

SEQ ID NO: 11502 - DNA, 201 bp, Homo sapiens; identical to SEQ ID NO: 11475

SEQ ID NO: 11503 - DNA, 201 bp, Homo sapiens; identical to SEQ ID NO: 11476

SEQ ID NO: 11504 - DNA, 201 bp, Homo sapiens; identical to SEQ ID NO: 11477

SEQ ID NO: 11505 - DNA, 201 bp, Homo sapiens; identical to SEQ ID NO: 11478

SEQ ID NO: 11506 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaagctatttcgtgtgagccgctggagagtcctgtccacggaagc

SEQ ID NO: 11507 - DNA, 201 bp, Homo sapiens; identical to SEQ ID NO: 11480

SEQ ID NO: 11508 - DNA, 201 bp, Homo sapiens
gtctagagggccagttacttaatggctctgcacaaacagcatgccaagagaatggccactggtcaactaccgtgccaacctgccaagcaggaccattgacyatccaggaagccctgacttactttggtggagcggtggcttctacgataggtctgataatgggtgggacgctcctggctttgctaagaaagcgtttcagac

SEQ ID NO: 11509 - DNA, 201 bp, Homo sapiens
ttcagttgtgaagagggatttgcattagttggaccggaagtggtgcaatgcacagcctcgggggtatggacagccccagccccagtgtgtaaagctatttygtgtgagccgctggagagtcctgtccacggaagcatggattgctctccatccttgagagcgtttcagtatgacaccaactgtagcttccgctgtgctgaa

SEQ ID NO: 11510 - DNA, 138 bp, Homo sapiens; identical to SEQ ID NO: 11482

SEQ ID NO: 11511 - DNA, 201 bp, Homo sapiens; identical to SEQ ID NO: 11483

SEQ ID NO: 11512 - DNA, 201 bp, Homo sapiens
aagagaatggccactggtcaactaccgtgccaacctgccaagcaggaccattgactatccaggaagccctgacttactttggtggagcggtggcttctacrataggtctgataatgggtgggacgctcctggctttgctaagaaagcgtttcagacaaaaagatgatgggaaatgccccttgaatcctcacagccacctag

SEQ ID NO: 11513 - DNA, 201 bp, Homo sapiens; identical to SEQ ID NO: 11484

SEQ ID NO: 11514 - DNA, 201 bp, Homo sapiens; identical to SEQ ID NO: 11456

SEQ ID NO: 11515 - DNA, 201 bp, Homo sapiens; identical to SEQ ID NO: 11457

SEQ ID NO: 11516 - DNA, 201 bp, Homo sapiens; identical to SEQ ID NO: 11458

SEQ ID NO: 11517 - DNA, 201 bp, Homo sapiens; identical to SEQ ID NO: 11459

SEQ ID NO: 11518 - DNA, 201 bp, Homo sapiens; identical to SEQ ID NO: 11460

SEQ ID NO: 11519 - DNA, 201 bp, Homo sapiens; identical to SEQ ID NO: 11461

SEQ ID NO: 11520 - DNA, 201 bp, Homo sapiens; identical to SEQ ID NO: 11462

SEQ ID NO: 11521 - DNA, 201 bp, Homo sapiens; identical to SEQ ID NO: 11492

SEQ ID NO: 11522 - DNA, 201 bp, Homo sapiens; identical to SEQ ID NO: 11464

SEQ ID NO: 11523 - DNA, 201 bp, Homo sapiens; identical to SEQ ID NO: 11465

SEQ ID NO: 11524 - DNA, 201 bp, Homo sapiens; identical to SEQ ID NO: 11466

SEQ ID NO: 11525 - DNA, 201 bp, Homo sapiens; identical to SEQ ID NO: 11467

SEQ ID NO: 11526 - DNA, 201 bp, Homo sapiens; identical to SEQ ID NO: 11468

SEQ ID NO: 11527 - DNA, 201 bp, Homo sapiens; identical to SEQ ID NO: 11469

SEQ ID NO: 11528 - DNA, 201 bp, Homo sapiens; identical to SEQ ID NO: 11470

SEQ ID NO: 11529 - DNA, 201 bp, Homo sapiens; identical to SEQ ID NO: 11471

SEQ ID NO: 11530 - DNA, 201 bp, Homo sapiens; identical to SEQ ID NO: 11472

SEQ ID NO: 11531 - DNA, 201 bp, Homo sapiens; identical to SEQ ID NO: 11473

SEQ ID NO: 11532 - DNA, 201 bp, Homo sapiens; identical to SEQ ID NO: 11474

SEQ ID NO: 11533 - DNA, 201 bp, Homo sapiens; identical to SEQ ID NO: 11475

SEQ ID NO: 11534 - DNA, 201 bp, Homo sapiens; identical to SEQ ID NO: 11476

SEQ ID NO: 11535 - DNA, 201 bp, Homo sapiens; identical to SEQ ID NO: 11477

SEQ ID NO: 11536 - DNA, 201 bp, Homo sapiens; identical to SEQ ID NO: 11478

SEQ ID NO: 11537 - DNA, 201 bp, Homo sapiens; identical to SEQ ID NO: 11479

SEQ ID NO: 11538 - DNA, 201 bp, Homo sapiens; identical to SEQ ID NO: 11508

SEQ ID NO: 11539 - DNA, 201 bp, Homo sapiens; identical to SEQ ID NO: 11480

SEQ ID NO: 11540 - DNA, 201 bp, Homo sapiens; identical to SEQ ID NO: 11481

SEQ ID NO: 11541 - DNA, 138 bp, Homo sapiens; identical to SEQ ID NO: 11482

SEQ ID NO: 11542 - DNA, 201 bp, Homo sapiens; identical to SEQ ID NO: 11483

SEQ ID NO: 11543 - DNA, 201 bp, Homo sapiens; identical to SEQ ID NO: 11512

SEQ ID NO: 11544 - DNA, 201 bp, Homo sapiens; identical to SEQ ID NO: 11484

SEQ ID NO: 11545 - DNA, 201 bp, Homo sapiens; identical to SEQ ID NO: 11456

SEQ ID NO: 11546 - DNA, 201 bp, Homo sapiens; identical to SEQ ID NO: 11457

SEQ ID NO: 11547 - DNA, 201 bp, Homo sapiens; identical to SEQ ID NO: 11458

SEQ ID NO: 11548 - DNA, 201 bp, Homo sapiens; identical to SEQ ID NO: 11459

SEQ ID NO: 11549 - DNA, 201 bp, Homo sapiens; identical to SEQ ID NO: 11460

SEQ ID NO: 11550 - DNA, 201 bp, Homo sapiens; identical to SEQ ID NO: 11461

SEQ ID NO: 11551 - DNA, 201 bp, Homo sapiens; identical to SEQ ID NO: 11462

SEQ ID NO: 11552 - DNA, 201 bp, Homo sapiens; identical to SEQ ID NO: 11492

SEQ ID NO: 11553 - DNA, 201 bp, Homo sapiens; identical to SEQ ID NO: 11464

SEQ ID NO: 11554 - DNA, 201 bp, Homo sapiens; identical to SEQ ID NO: 11465

SEQ ID NO: 11555 - DNA, 201 bp, Homo sapiens; identical to SEQ ID NO: 11466

SEQ ID NO: 11556 - DNA, 201 bp, Homo sapiens; identical to SEQ ID NO: 11467

SEQ ID NO: 11557 - DNA, 201 bp, Homo sapiens; identical to SEQ ID NO: 11468

SEQ ID NO: 11558 - DNA, 201 bp, Homo sapiens; identical to SEQ ID NO: 11469

SEQ ID NO: 11559 - DNA, 201 bp, Homo sapiens; identical to SEQ ID NO: 11470

SEQ ID NO: 11560 - DNA, 201 bp, Homo sapiens; identical to SEQ ID NO: 11471

SEQ ID NO: 11561 - DNA, 201 bp, Homo sapiens; identical to SEQ ID NO: 11472

SEQ ID NO: 11562 - DNA, 201 bp, Homo sapiens; identical to SEQ ID NO: 11473

SEQ ID NO: 11563 - DNA, 201 bp, Homo sapiens; identical to SEQ ID NO: 11474

SEQ ID NO: 11564 - DNA, 201 bp, Homo sapiens; identical to SEQ ID NO: 11475

SEQ ID NO: 11565 - DNA, 201 bp, Homo sapiens; identical to SEQ ID NO: 11476

SEQ ID NO: 11566 - DNA, 201 bp, Homo sapiens; identical to SEQ ID NO: 11477

SEQ ID NO: 11567 - DNA, 201 bp, Homo sapiens; identical to SEQ ID NO: 11478

SEQ ID NO: 11568 - DNA, 201 bp, Homo sapiens; identical to SEQ ID NO: 11479

SEQ ID NO: 11569 - DNA, 201 bp, Homo sapiens; identical to SEQ ID NO: 11508

SEQ ID NO: 11570 - DNA, 201 bp, Homo sapiens; identical to SEQ ID NO: 11480

SEQ ID NO: 11571 - DNA, 201 bp, Homo sapiens; identical to SEQ ID NO: 11481

SEQ ID NO: 11572 - DNA, 138 bp, Homo sapiens; identical to SEQ ID NO: 11482

SEQ ID NO: 11573 - DNA, 201 bp, Homo sapiens; identical to SEQ ID NO: 11483

SEQ ID NO: 11574 - DNA, 201 bp, Homo sapiens; identical to SEQ ID NO: 11512

SEQ ID NO: 11575 - DNA, 201 bp, Homo sapiens; identical to SEQ ID NO: 11484

SEQ ID NO: 11576 - DNA, 201 bp, Homo sapiens
aaactacagggctcctttgatgtcagtgtcaagggcatcagcatttcggtcaacctcctgttgggcagcgagtcctccgggaggcccacagttactgcctscagctgcagcagtgacatcgctgacgtggaggtggacatgtcgggagacttggggtggctgttgaacctcttccacaaccagattgagtccaagttccag

SEQ ID NO: 11577 - DNA, 201 bp, Homo sapiens
ccctccccgactggcctgggatatctttacaagcaggcactgtatttttttattcgccatctgatccccatgcctagcagagtgctggcacttagtaggtyctcaataaatatttattaaatgatgagatgatggaatcacctggtattctagctgagcctcatcactgcctgccctcttctgacctcaggggtctttgga

SEQ ID NO: 11578 - DNA, 201 bp, Homo sapiens
ggatcaccgacaagggactgcagtatgcggcccaggaggggctattggctctgcagagtgagctgctcaggatcacgctgcctgacttcaccggggacttraggatcccccacgtcggccgtgggcgctatgagttccacagcctgaacatccacagctgtgagctgcttcactctgcgctgaggcctgtccctggccagg

SEQ ID NO: 11579 - DNA, 201 bp, Homo sapiens
atccataaggacttcctgttcttgggtgccaatgtccaatacatgagagtttgaggacaagaaagatgaagcttggaggtcacagctggatctgcttgttscatttccagctgtgcagcacgtctcagagattcttgaagaatgaagacatttctgctctcagctccgggggtgaggtgtgcctggcctctgcctccaccc

SEQ ID NO: 11580 - DNA, 201 bp, Homo sapiens
tgctgcttacgtccaccccagaggctctgggtgccaaccccggcttggtcgccaggatcaccgacaagggactgcagtatgcggcccaggaggggctattrgctctgcagagtgagctgctcaggatcacgctgcctgacttcaccggggacttgaggatcccccacgtcggccgtgggcgctatgagttccacagcctga

SEQ ID NO: 11581 - DNA, 201 bp, Homo sapiens
tgcgctgaggcctgtccctggccagggcctgagtctcagcatctccgactcctccatccgggtccagggcaggtggaaggtgcgcaagtcattcttcaaamtacagggctcctttgatgtcagtgtcaagggcatcagcatttcggtcaacctcctgttgggcagcgagtcctccgggaggcccacagttactgcctccag

SEQ ID NO: 11582 - DNA, 201 bp, Homo sapiens
tccgctcctgaacttcagccctgggaatctgtctgtggacccctatatggagatagatgcctttgtgctcctgcccagctccagcaaggagcctgtcttcyggctcagtgtggccactaatgtgtccgccaccttgaccttcaataccagcaagatcactgggttcctgaagccaggaaaggtaaaagtggaactgaaaga

SEQ ID NO: 11583 - DNA, 201 bp, Homo sapiens
aacttctccatcacagatgacatgataccgcctgactctaatatccgactgaccaccaagtccttccgacccttcgtcccacggttagccaggctctaccycaacatgaacctggaactccagggatcagtgccctctgctccgctcctgaacttcagccctgggaatctgtctgtggacccctatatggagatagatgcc

SEQ ID NO: 11584 - DNA, 201 bp, Homo sapiens
gggcaggtggaaggtgcgcaagtcattcttcaaactacagggctcctttgatgtcagtgtcaagggcatcagcatttcggtcaacctcctgttgggcagcragtcctccgggaggcccacagttactgcctccagctgcagcagtgacatcgctgacgtggaggtggacatgtcgggagacttggggtggctgttgaacct

SEQ ID NO: 11585 - DNA, 201 bp, Homo sapiens
agtcattcttcaaactacagggctcctttgatgtcagtgtcaagggcatcagcatttcggtcaacctcctgttgggcagcgagtcctccgggaggcccacrgttactgcctccagctgcagcagtgacatcgctgacgtggaggtggacatgtcgggagacttggggtggctgttgaacctcttccacaaccagattgagt

SEQ ID NO: 11586 - DNA, 152 bp, Homo sapiens
ctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatgcg

SEQ ID NO: 11587 - DNA, 201 bp, Homo sapiens
tgacatgataccgcctgactctaatatccgactgaccaccaagtccttccgacccttcgtcccacggttagccaggctctaccccaacatgaacctggaaytccagggatcagtgccctctgctccgctcctgaacttcagccctgggaatctgtctgtggacccctatatggagatagatgcctttgtgctcctgcccag

SEQ ID NO: 11588 - DNA, 201 bp, Homo sapiens
tcacagatgacatgataccgcctgactctaatatccgactgaccaccaagtccttccgacccttcgtcccacggttagccaggctctaccccaacatgaamctggaactccagggatcagtgccctctgctccgctcctgaacttcagccctgggaatctgtctgtggacccctatatggagatagatgcctttgtgctcc

SEQ ID NO: 11589 - DNA, 201 bp, Homo sapiens
tggtttatcatgaggaaggatatctgaacttctccatcacagatgacatgataccgcctgactctaatatccgactgaccaccaagtccttccgacccttygtcccacggttagccaggctctaccccaacatgaacctggaactccagggatcagtgccctctgctccgctcctgaacttcagccctgggaatctgtctg

SEQ ID NO: 11590 - DNA, 201 bp, Homo sapiens
accctccttgctgcagtcatgagccttcctgaggaacacaacaaaatggtctactttgccatctcggattatgtcttcaacacggccagcctggtttatcrtgaggaaggatatctgaacttctccatcacagatgacatgataccgcctgactctaatatccgactgaccaccaagtccttccgacccttcgtcccacgg

SEQ ID NO: 11591 - DNA, 201 bp, Homo sapiens
ctctaccccaacatgaacctggaactccagggatcagtgccctctgctccgctcctgaacttcagccctgggaatctgtctgtggacccctatatggagayagatgcctttgtgctcctgcccagctccagcaaggagcctgtcttccggctcagtgtggccactaatgtgtccgccaccttgaccttcaataccagcaag

SEQ ID NO: 11592 - DNA, 201 bp, Homo sapiens
gaaatctttcatcgtaaccaccgttctccagttaccctccttgctgcagtcatgagccttcctgaggaacacaacaaaatggtctactttgccatctcggrttatgtcttcaacacggccagcctggtttatcatgaggaaggatatctgaacttctccatcacagatgacatgataccgcctgactctaatatccgactg

SEQ ID NO: 11593 - DNA, 201 bp, Homo sapiens
gaagccaggaaaggtaaaagtggaactgaaagaatccaaagttggactattcaatgcagagctgttggaagcgctcctcaactattacatccttaacaccytctaccccaagttcaatgataagttggccgaaggcttcccccttcctctgctgaagcgtgttcagctctacgaccttgggctgcagatccataaggactt

SEQ ID NO: 11594 - DNA, 201 bp, Homo sapiens
gggacttgaggatcccccacgtcggccgtgggcgctatgagttccacagcctgaacatccacagctgtgagctgcttcactctgcgctgaggcctgtcccyggccagggcctgagtctcagcatctccgactcctccatccgggtccagggcaggtggaaggtgcgcaagtcattcttcaaactacagggctcctttgatg

SEQ ID NO: 11595 - DNA, 201 bp, Homo sapiens
atccaaagttggactattcaatgcagagctgttggaagcgctcctcaactattacatccttaacaccttctaccccaagttcaatgataagttggccgaargcttcccccttcctctgctgaagcgtgttcagctctacgaccttgggctgcagatccataaggacttcctgttcttgggtgccaatgtccaatacatgag

SEQ ID NO: 11596 - DNA, 201 bp, Homo sapiens
ggggtggctgttgaacctcttccacaaccagattgagtccaagttccagaaagtactggagagcaggatttgcgaaatgatccagaaatcagtgtcctccratctacagccttatctccaaactctgccagttacaacagagattgacagtttcgccgacattgattatagcttagtggaagcccctcgggcaacagccca

SEQ ID NO: 11597 - DNA, 201 bp, Homo sapiens
aagatcactgggttcctgaagccaggaaaggtaaaagtggaactgaaagaatccaaagttggactattcaatgcagagctgttggaagcgctcctcaactrttacatccttaacaccttctaccccaagttcaatgataagttggccgaaggcttcccccttcctctgctgaagcgtgttcagctctacgaccttgggctg

SEQ ID NO: 11598 - DNA, 201 bp, Homo sapiens
cgggagacttggggtggctgttgaacctcttccacaaccagattgagtccaagttccagaaagtactggagagcaggatttgcgaaatgatccagaaatcrgtgtcctccgatctacagccttatctccaaactctgccagttacaacagagattgacagtttcgccgacattgattatagcttagtggaagcccctcggg

SEQ ID NO: 11599 - DNA, 201 bp, Homo sapiens
tacagccttatctccaaactctgccagttacaacagagattgacagtttcgccgacattgattatagcttagtggaagcccctcgggcaacagcccagatrctggaggtgatgtttaagggtgaaatctttcatcgtaaccaccgttctccagttaccctccttgctgcagtcatgagccttcctgaggaacacaacaaaa

SEQ ID NO: 11600 - DNA, 201 bp, Homo sapiens
ttccacagcctgaacatccacagctgtgagctgcttcactctgcgctgaggcctgtccctggccagggcctgagtctcagcatctccgactcctccatccrggtccagggcaggtggaaggtgcgcaagtcattcttcaaactacagggctcctttgatgtcagtgtcaagggcatcagcatttcggtcaacctcctgttg

SEQ ID NO: 11601 - DNA, 201 bp, Homo sapiens
gtgcctggcctctgcctccaccctcctcctcttcaccaggtgcatgcatgccctctctgagtctggactttgcttcccctccaggagggaccaccctcccygactggcctgggatatctttacaagcaggcactgtatttttttattcgccatctgatccccatgcctagcagagtgctggcacttagtaggtcctcaata

SEQ ID NO: 11602 - DNA, 201 bp, Homo sapiens
aagaatccaaagttggactattcaatgcagagctgttggaagcgctcctcaactattacatccttaacaccttctaccccaagttcaatgataagttggcygaaggcttcccccttcctctgctgaagcgtgttcagctctacgaccttgggctgcagatccataaggacttcctgttcttgggtgccaatgtccaataca

SEQ ID NO: 11603 - DNA, 201 bp, Homo sapiens
cttgggtgccaatgtccaatacatgagagtttgaggacaagaaagatgaagcttggaggtcacagctggatctgcttgttgcatttccagctgtgcagcaygtctcagagattcttgaagaatgaagacatttctgctctcagctccgggggtgaggtgtgcctggcctctgcctccaccctcctcctcttcaccaggtgc

SEQ ID NO: 11604 - DNA, 201 bp, Homo sapiens
catgaggaaggatatctgaacttctccatcacagatgacatgataccgcctgactctaatatccgactgaccaccaagtccttccgacccttcgtcccacrgttagccaggctctaccccaacatgaacctggaactccagggatcagtgccctctgctccgctcctgaacttcagccctgggaatctgtctgtggacccc

SEQ ID NO: 11605 - DNA, 201 bp, Homo sapiens
gaaagaatccaaagttggactattcaatgcagagctgttggaagcgctcctcaactattacatccttaacaccttctaccccaagttcaatgataagttgrccgaaggcttcccccttcctctgctgaagcgtgttcagctctacgaccttgggctgcagatccataaggacttcctgttcttgggtgccaatgtccaata

SEQ ID NO: 11606 - DNA, 201 bp, Homo sapiens
gttccacagcctgaacatccacagctgtgagctgcttcactctgcgctgaggcctgtccctggccagggcctgagtctcagcatctccgactcctccatcygggtccagggcaggtggaaggtgcgcaagtcattcttcaaactacagggctcctttgatgtcagtgtcaagggcatcagcatttcggtcaacctcctgtt

SEQ ID NO: 11607 - DNA, 201 bp, Homo sapiens
ggttagccaggctctaccccaacatgaacctggaactccagggatcagtgccctctgctccgctcctgaacttcagccctgggaatctgtctgtggacccstatatggagatagatgcctttgtgctcctgcccagctccagcaaggagcctgtcttccggctcagtgtggccactaatgtgtccgccaccttgaccttca

SEQ ID NO: 11608 - DNA, 201 bp, Homo sapiens
tgcctgacttcaccggggacttgaggatcccccacgtcggccgtgggcgctatgagttccacagcctgaacatccacagctgtgagctgcttcactctgcrctgaggcctgtccctggccagggcctgagtctcagcatctccgactcctccatccgggtccagggcaggtggaaggtgcgcaagtcattcttcaaactac

SEQ ID NO: 11609 - DNA, 201 bp, Homo sapiens
tgtcaagggcatcagcatttcggtcaacctcctgttgggcagcgagtcctccgggaggcccacagttactgcctccagctgcagcagtgacatcgctgacrtggaggtggacatgtcgggagacttggggtggctgttgaacctcttccacaaccagattgagtccaagttccagaaagtactggagagcaggatttgcga

SEQ ID NO: 11610 - DNA, 201 bp, Homo sapiens
gcagcgagtcctccgggaggcccacagttactgcctccagctgcagcagtgacatcgctgacgtggaggtggacatgtcgggagacttggggtggctgttkaacctcttccacaaccagattgagtccaagttccagaaagtactggagagcaggatttgcgaaatgatccagaaatcagtgtcctccgatctacagcctt

SEQ ID NO: 11611 - DNA, 201 bp, Homo sapiens
ggcctgtcagagcctgaagaagatattggagacacagcggttcgagaagtttttgaagagactggtataaaatcagaattcaggtccgtcctgagtattcrgcaacagcacacaaatcctggagcttttgggaagtcagatatgtatatcatctgccgcctaaagccatattcattcaccataaatttttgccaggaagaa

SEQ ID NO: 11612 - DNA, 112 bp, Homo sapiens
atgcggcagccrctgagctggggccgctggcgcgcgatgcttgcccgaacctacggccccgggccttcggcgggttaccgctgggcctcgggcgcacagggttacgtgcgga

SEQ ID NO: 11613 - DNA, 201 bp, Homo sapiens
tgcagtacagcaatggcgatcagaaggtagaacagctgtatggctgcacattcccatcctccaaagccgatttattgcccctgctgcttccctgggcttcygctttcaccacgcagaatcggattcatcaacgttgactctgtggctgagagaagggcccagcagattaccaggatatgcttcacatcaagtaggagttgc

SEQ ID NO: 11614 - DNA, 106 bp, Homo sapiens
cgaatyaagcggcgtggagatgcggcagccgctgagctggggccgctggcgcgcgatgcttgcccgaacctacggccccgggccttcggcgggttaccgctgggcc

SEQ ID NO: 11615 - DNA, 201 bp, Homo sapiens; identical to SEQ ID NO: 11611

SEQ ID NO: 11616 - DNA, 131 bp, Homo sapiens
cgaattaagcggcgtggagatgcggcagccrctgagctggggccgctggcgcgcgatgcttgcccgaacctacggccccgggccttcggcgggttaccgctgggcctcgggcgcacagggttacgtgcgga

SEQ ID NO: 11617 - DNA, 201 bp, Homo sapiens
ggcaatacagcaatggcgatcagaaggtagaacagctgtatggctgcacattcccatcctccaaagccgatttattgcccctgctgcttccctgggcttcygctttcaccacgcagaatcggattcatcaacgttgactctgtggctgagagaagggcccagcagattaccaggatatgcttcacatcaagtaggagttgc

SEQ ID NO: 11618 - DNA, 201 bp, Homo sapiens; identical to SEQ ID NO: 11611

SEQ ID NO: 11619 - DNA, 201 bp, Homo sapiens; identical to SEQ ID NO: 11613

SEQ ID NO: 11620 - DNA, 109 bp, Homo sapiens
ggacgaatyaagcggcgtggagatgcggcagccgctgagctggggccgctggcgcgcgatgcttgcccgaacctacggccccgggccttcggcgggttaccgctgggcc

SEQ ID NO: 11621 - DNA, 201 bp, Homo sapiens; identical to SEQ ID NO: 11611

SEQ ID NO: 11622 - DNA, 134 bp, Homo sapiens
ggacgaattaagcggcgtggagatgcggcagccrctgagctggggccgctggcgcgcgatgcttgcccgaacctacggccccgggccttcggcgggttaccgctgggcctcgggcgcacagggttacgtgcgga

SEQ ID NO: 11623 - DNA, 201 bp, Homo sapiens; identical to SEQ ID NO: 11613

SEQ ID NO: 11624 - DNA, 201 bp, Homo sapiens
actctgaacacgctggttatctaaatgagaagcagagaaataaagtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggatagagtcttga

SEQ ID NO: 11625 - DNA, 201 bp, Homo sapiens
ggctttttttcctatgtctcttgggaactgcagctgcaatcccgacaaatgcaagattattatctgatcattccaaaccaactgctgaaacggtagcaccygacaacactgcaatccccagtttaagggctgaagctgaagaaaatgaaaaagaaacagcagtatccacagaagacgattcccaccataaggctgaaaaat

SEQ ID NO: 11626 - DNA, 201 bp, Homo sapiens
atcccgacaaatgcaagattattatctgatcattccaaaccaactgctgaaacggtagcacctgacaacactgcaatccccagtttaagggctgaagctgragaaaatgaaaaagaaacagcagtatccacagaagacgattcccaccataaggctgaaaaatcatcagtactaaagtcaaaagaggaaagccatgaacag

SEQ ID NO: 11627 - DNA, 201 bp, Homo sapiens
gcaaagagaaaaagtacatgaaaatgaaaatataggtaccactgagcctggagagcaccaagaggccaagaaagcagagaactcatcaaatgaggaggaarcgtcaagtgaaggcaacatgagggtgcatgctgtggattcttgcatgagcttccagtgtaaaagaggccacatctgtaaggcagaccaacagggaaaacc

SEQ ID NO: 11628 - DNA, 201 bp, Homo sapiens
agaaagacagaattgcccagggagcatgctaacagcaagcaggaggaagacaatacccaatctgatgatattttggaagagtctgatcaaccaactcaagwaagcaagatgcaggaggatgaatttgatcagggtaaccaagaacaagaagataactccaatgcagaaatggaagaggaaaatgcatcgaacgtcaataag

SEQ ID NO: 11629 - DNA, 201 bp, Homo sapiens
tctgaggctctgctcatggaacctactgatgatggtaataccacgcccagaaatcatggagttgatgatgatggcgatgatgatggcgatgatggcggcamtgatggccccaggcacagtgcaagtgatgactacttcatcccaagccaggcctttctggaggccgagagagctcaatccattgcctatcacctcaaaatt

SEQ ID NO: 11630 - DNA, 201 bp, Homo sapiens
ccccaacaaggataagcacatcaccctgaaggagtggggccactgctttggaattaaagaagaggacatagatgaaaatctcttgttttgaacgaagattwtaaagaactcaactttccagcatcctcctctgttctaaccacttcagaaatatatgcagctgtgatacttgtagatttatatttagcaaaatgttagcat

SEQ ID NO: 11631 - DNA, 201 bp, Homo sapiens
gcaatcccgacaaatgcaagattattatctgatcattccaaaccaactgctgaaacggtagcacctgacaacactgcaatccccagtttaagggctgaagmtgaagaaaatgaaaaagaaacagcagtatccacagaagacgattcccaccataaggctgaaaaatcatcagtactaaagtcaaaagaggaaagccatgaa

SEQ ID NO: 11632 - DNA, 201 bp, Homo sapiens
agtactaaagtcaaaagaggaaagccatgaacagtcagcagaacagggcaagagttctagccaagagctgggattgaaggatcaagaggacagtgatggtsacttaagtgtgaatttggagtatgcaccaactgaaggtacattggacataaaagaagatatgagtgagcctcaggagaaaaaactctcagagaacactga

SEQ ID NO: 11633 - DNA, 201 bp, Homo sapiens; identical to SEQ ID NO: 11624

SEQ ID NO: 11634 - DNA, 201 bp, Homo sapiens; identical to SEQ ID NO: 11625

SEQ ID NO: 11635 - DNA, 201 bp, Homo sapiens; identical to SEQ ID NO: 11626

SEQ ID NO: 11636 - DNA, 201 bp, Homo sapiens; identical to SEQ ID NO: 11627

SEQ ID NO: 11637 - DNA, 201 bp, Homo sapiens; identical to SEQ ID NO: 11628

SEQ ID NO: 11638 - DNA, 201 bp, Homo sapiens; identical to SEQ ID NO: 11629

SEQ ID NO: 11639 - DNA, 201 bp, Homo sapiens; identical to SEQ ID NO: 11630

SEQ ID NO: 11640 - DNA, 201 bp, Homo sapiens; identical to SEQ ID NO: 11631

SEQ ID NO: 11641 - DNA, 201 bp, Homo sapiens; identical to SEQ ID NO: 11632

SEQ ID NO: 11642 - DNA, 201 bp, Homo sapiens
ctgaaatactctctggtgccaacctccaaattctcgtctgtcacttcagacccccactagttgacagagcagcagaatttcaactccagtagacttgaatrtgcctctgggcaaagaagcagagctaacgaggaaagggatttaaagagtttttcttgggtgtttgtcaaacttttattccctgtctgtgtgcagagggga

SEQ ID NO: 11643 - DNA, 201 bp, Homo sapiens
ctgcaacaaaaacgatgacagtctgaaatactctctggtgccaacctccaaattctcgtctgtcacttcagacccccactagttgacagagcagcagaatwtcaactccagtagacttgaatatgcctctgggcaaagaagcagagctaacgaggaaagggatttaaagagtttttcttgggtgtttgtcaaacttttatt

SEQ ID NO: 11644 - DNA, 201 bp, Homo sapiens
cccaatacataccactttgaataggatgataggaaataaatgatgtactacattaaattaaattattgtattacatttttgtacacatcagtcattcccasgcttggctgaaaatcaggatcatctgagaaacttaaacaatttctgcattcttaatctccactgttattctattatatcagaatcgctaatagaaccaag

SEQ ID NO: 11645 - DNA, 201 bp, Homo sapiens
ggagtagaagccaaaaggatctttaaaaaggattgagcattattcttggcgcacagtccaaaatacaaattggacagaagatctatattgtaccagaactrtttatttcaccccatcaagtataaggttactgattgattggtccttttataaacattggtatatttccattcatgccaaagcaaaagaagtaaaagctaa

SEQ ID NO: 11646 - DNA, 201 bp, Homo sapiens
agggaaataaacttattggaaaattcaaacggacagacaatggaaacgaactgaatactgtccgagaaattataggtgatgaactagtccagacttatgtrtatgaaggagtagaagccaaaaggatctttaaaaaggattgagcattattcttggcgcacagtccaaaatacaaattggacagaagatctatattgtacc

SEQ ID NO: 11647 - DNA, 201 bp, Homo sapiens
ttctaagtggtatatacatatgacatatatattaaaatgtaggaagaaaaatgtttgagtacctgatgaaaatgaatagagagtatgtaatctttgaaagstgaatactgcgtgttctcacttataagtgggagctaaataatgtatacacatggacacaccagagtgtagaataatagacactggagacttggaagagtt

SEQ ID NO: 11648 - DNA, 201 bp, Homo sapiens
tttcacataaacacatacattgccaattttccagggctcaaaaagtttccttttattcatattttcacatgacgtaaaattttatgtgcttcacataattktattttagcagggtacatattaggggatggagagggggtacaatttttaagcatttgcagctgcaactctatagacttttgacaaattctttttcacact

SEQ ID NO: 11649 - DNA, 201 bp, Homo sapiens
ctgtccgagaaattataggtgatgaactagtccagacttatgtgtatgaaggagtagaagccaaaaggatctttaaaaaggattgagcattattcttggcrcacagtccaaaatacaaattggacagaagatctatattgtaccagaactatttatttcaccccatcaagtataaggttactgattgattggtccttttat

SEQ ID NO: 11650 - DNA, 201 bp, Homo sapiens
ctattatatcagaatcgctaatagaaccaagaattctagaaaatttcctggtgattctgatgcagcctgtccactaacttgtctttgagaacaatggagayatcagttatcaatgttatttttaaccacccccttcttttttgttgttgtgggttttttcacataaacacatacattgccaattttccagggctcaaaaag

SEQ ID NO: 11651 - DNA, 201 bp, Homo sapiens
tatatacatatgacatatatattaaaatgtaggaagaaaaatgtttgagtacctgatgaaaatgaatagagagtatgtaatctttgaaagctgaatactgygtgttctcacttataagtgggagctaaataatgtatacacatggacacaccagagtgtagaataatagacactggagacttggaagagttggagggttgg

SEQ ID NO: 11652 - DNA, 201 bp, Homo sapiens
gtacaatttttaagcatttgcagctgcaactctatagacttttgacaaattctttttcacactgatgtagataacagcttaacatttacatagttcttackacttgccacacactgttctaagtggtatatacatatgacatatatattaaaatgtaggaagaaaaatgtttgagtacctgatgaaaatgaatagagagta

SEQ ID NO: 11653 - DNA, 201 bp, Homo sapiens
caaaaagtttccttttattcatattttcacatgacgtaaaattttatgtgcttcacataattgtattttagcagggtacatattaggggatggagaggggktacaatttttaagcatttgcagctgcaactctatagacttttgacaaattctttttcacactgatgtagataacagcttaacatttacatagttcttact

SEQ ID NO: 11654 - DNA, 201 bp, Homo sapiens
gaagtaaaagctaattaggatttaatttgttttatattctctaagatatatatttactaaaagaatttgtgacattttaaaaaacaaaaataaatattgcrtccatgttgctttatatgtagccttgccttttaaaagaaaaagtatgtgaatatgaattgacagactgttttcgtagagagagggtcttactctttcact

SEQ ID NO: 11655 - DNA, 201 bp, Homo sapiens
aaagtttccttttattcatattttcacatgacgtaaaattttatgtgcttcacataattgtattttagcagggtacatattaggggatggagagggggtamaatttttaagcatttgcagctgcaactctatagacttttgacaaattctttttcacactgatgtagataacagcttaacatttacatagttcttactact

SEQ ID NO: 11656 - DNA, 201 bp, Homo sapiens
tatatgtagccttgccttttaaaagaaaaagtatgtgaatatgaattgacagactgttttcgtagagagagggtcttactctttcactcaggctggaatgyagtggagagatcatagctcactgtaacctcaaactcctggactcatgcaatcttcctgcctcaggcttctgagtagctaggactatgggtacattccaca

SEQ ID NO: 11657 - DNA, 201 bp, Homo sapiens
ttgtgacattttaaaaaacaaaaataaatattgcgtccatgttgctttatatgtagccttgccttttaaaagaaaaagtatgtgaatatgaattgacagaytgttttcgtagagagagggtcttactctttcactcaggctggaatgtagtggagagatcatagctcactgtaacctcaaactcctggactcatgcaatct

SEQ ID NO: 11658 - DNA, 201 bp, Homo sapiens
tgacaattacacaagaaggaaataaattcacagtcaaagaatcaagcgcttttcgaaacattgaagttgtttttgaacttggtgtcacctttaattacaayctagcagacggaactgaactcagggggacctggagccttgagggaaataaacttattggaaaattcaaacggacagacaatggaaacgaactgaatactg

SEQ ID NO: 11659 - DNA, 201 bp, Homo sapiens
aatgggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaatctagcagacggaactgaactcagggggacctggagccttgagggaaa

SEQ ID NO: 11660 - DNA, 201 bp, Homo sapiens
ggctgtgcagggcgtgtccttcaagatccacgcaggagagaaggtgggcatcgttggcaggaccggggcagggaagtcctccctggccagtgggctgctgyggctccaggaggcagctgagggtgggatctggatcgacggggtccccattgcccacgtggggctgcacacactgcgctccaggatcagcatcatccccca

SEQ ID NO: 11661 - DNA, 201 bp, Homo sapiens
gggtgggatctggatcgacggggtccccattgcccacgtggggctgcacacactgcgctccaggatcagcatcatcccccaggaccccatcctgttccctsgctctctgcggatgaacctcgacctgctgcaggagcactcggacgaggctatctgggcagccctggagacggtgcagctcaaagccttggtggccagcct

SEQ ID NO: 11662 - DNA, 201 bp, Homo sapiens
ctcggacgaggctatctgggcagccctggagacggtgcagctcaaagccttggtggccagcctgcccggccagctgcagtacaagtgtgctgaccgaggcraggacctgagcgtgggccagaaacagctcctgtgtctggcacgtgcccttctccggaagacccagatcctcatcctggacgaggctactgctgccgtgga

SEQ ID NO: 11663 - DNA, 201 bp, Homo sapiens
cggatgcaggactatgcctggacgcccaaggaggctccctggaggctgcccacatgtgcagctcagcccccctggcctcagggcgggcagatcgagttccrggactttgggctaagataccgacctgagctcccgctggctgtgcagggcgtgtccttcaagatccacgcaggagagaaggtgggcatcgttggcaggacc

SEQ ID NO: 11664 - DNA, 201 bp, Homo sapiens
gtggcagagagcggcagcccggcccagctgctggcccagaagggcctgttttacagactggcccaggagtcaggcctggtctgagccaggaccctcaaccrtaccccagttggaccagcccgcacagcctgcagtgctggagatggaagtgacccgtggtcatcgatagctccacacgatattgagtctagacctgtgttt

SEQ ID NO: 11665 - DNA, 201 bp, Homo sapiens
cccctggcctcagggcgggcagatcgagttccgggactttgggctaagataccgacctgagctcccgctggctgtgcagggcgtgtccttcaagatccacrcaggagagaaggtgggcatcgttggcaggaccggggcagggaagtcctccctggccagtgggctgctgcggctccaggaggcagctgagggtgggatctg

SEQ ID NO: 11666 - DNA, 201 bp, Homo sapiens
ctccccagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaact

SEQ ID NO: 11667 - DNA, 201 bp, Homo sapiens
ggagcactcggacgaggctatctgggcagccctggagacggtgcagctcaaagccttggtggccagcctgcccggccagctgcagtacaagtgtgctgacygaggcgaggacctgagcgtgggccagaaacagctcctgtgtctggcacgtgcccttctccggaagacccagatcctcatcctggacgaggctactgctgc

SEQ ID NO: 11668 - DNA, 201 bp, Homo sapiens
ccagcctgcccggccagctgcagtacaagtgtgctgaccgaggcgaggacctgagcgtgggccagaaacagctcctgtgtctggcacgtgcccttctccgraagacccagatcctcatcctggacgaggctactgctgccgtggaccctggcacggagctgcagatgcaggccatgctcgggagctggtttgcacagtgca

SEQ ID NO: 11669 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcaggtggcttgcggccaatgtggagctcctggggaatggcctggtgtttgcagctgccacgtgtgctgtgctgagcaaagcccacc

SEQ ID NO: 11670 - DNA, 201 bp, Homo sapiens
ctgcagtacaagtgtgctgaccgaggcgaggacctgagcgtgggccagaaacagctcctgtgtctggcacgtgcccttctccggaagacccagatcctcaycctggacgaggctactgctgccgtggaccctggcacggagctgcagatgcaggccatgctcgggagctggtttgcacagtgcactgtgctgctcattgcc

SEQ ID NO: 11671 - DNA, 201 bp, Homo sapiens
gatcgagttccgggactttgggctaagataccgacctgagctcccgctggctgtgcagggcgtgtccttcaagatccacgcaggagagaaggtgggcatckttggcaggaccggggcagggaagtcctccctggccagtgggctgctgcggctccaggaggcagctgagggtgggatctggatcgacggggtccccattgc

SEQ ID NO: 11672 - DNA, 201 bp, Homo sapiens
cgggactttgggctaagataccgacctgagctcccgctggctgtgcagggcgtgtccttcaagatccacgcaggagagaaggtgggcatcgttggcaggaycggggcagggaagtcctccctggccagtgggctgctgcggctccaggaggcagctgagggtgggatctggatcgacggggtccccattgcccacgtgggg

SEQ ID NO: 11673 - DNA, 201 bp, Homo sapiens
ggactttgggctaagataccgacctgagctcccgctggctgtgcagggcgtgtccttcaagatccacgcaggagagaaggtgggcatcgttggcaggaccrgggcagggaagtcctccctggccagtgggctgctgcggctccaggaggcagctgagggtgggatctggatcgacggggtccccattgcccacgtggggct

SEQ ID NO: 11674 - DNA, 201 bp, Homo sapiens
gctgtgcagggcgtgtccttcaagatccacgcaggagagaaggtgggcatcgttggcaggaccggggcagggaagtcctccctggccagtgggctgctgcrgctccaggaggcagctgagggtgggatctggatcgacggggtccccattgcccacgtggggctgcacacactgcgctccaggatcagcatcatcccccag

SEQ ID NO: 11675 - DNA, 201 bp, Homo sapiens
caagatccacgcaggagagaaggtgggcatcgttggcaggaccggggcagggaagtcctccctggccagtgggctgctgcggctccaggaggcagctgagrgtgggatctggatcgacggggtccccattgcccacgtggggctgcacacactgcgctccaggatcagcatcatcccccaggaccccatcctgttccctgg

SEQ ID NO: 11676 - DNA, 201 bp, Homo sapiens
ggctccaggaggcagctgagggtgggatctggatcgacggggtccccattgcccacgtggggctgcacacactgcgctccaggatcagcatcatcccccasgaccccatcctgttccctggctctctgcggatgaacctcgacctgctgcaggagcactcggacgaggctatctgggcagccctggagacggtgcagctca

SEQ ID NO: 11677 - DNA, 201 bp, Homo sapiens
catctcgccctgtccaccctgcagccaatgtcaacagcgactctcagccccgctgtactctggactcacctgggggcctcaagcacatgcccaggctcccrgctagacccttaaatcagaatctctgaggctgggaactgccatgctgtgtgtactttttacaaattaacacttttattttgggataatcccagactcaca

SEQ ID NO: 11678 - DNA, 201 bp, Homo sapiens
ggtccccattgcccacgtggggctgcacacactgcgctccaggatcagcatcatcccccaggaccccatcctgttccctggctctctgcggatgaacctcracctgctgcaggagcactcggacgaggctatctgggcagccctggagacggtgcagctcaaagccttggtggccagcctgcccggccagctgcagtacaa

SEQ ID NO: 11679 - DNA, 201 bp, Homo sapiens; identical to SEQ ID NO: 11660

SEQ ID NO: 11680 - DNA, 201 bp, Homo sapiens
accgtctggtcaccttcctctgcctggaagaagttgaccctggtgtcgtagactcaagttcctctggaagcgctgccgggaaggattgcatcacgatacamagtgccaccttcgcctggtcccaggaaagccctccctgcctccacagaataaacctcacggtgccccagggctgtctgctggctgttgtcggtccagtgg

SEQ ID NO: 11681 - DNA, 201 bp, Homo sapiens
gttccagggcagcacagtggtccgggcattccgaacccaggccccctttgtggctcagaacaatgctcgcgtagatgaaagccagaggatcagtttcccgygactggtggctgacaggtggcttgcggccaatgtggagctcctggggaatggcctggtgtttgcagctgccacgtgtgctgtgctgagcaaagcccacct

SEQ ID NO: 11682 - DNA, 201 bp, Homo sapiens
cctttgaccgtctggtcaccttcctctgcctggaagaagttgaccctggtgtcgtagactcaagttcctctggaagcgctgccgggaaggattgcatcacsatacaaagtgccaccttcgcctggtcccaggaaagccctccctgcctccacagaataaacctcacggtgccccagggctgtctgctggctgttgtcggtc

SEQ ID NO: 11683 - DNA, 201 bp, Homo sapiens
caaagtgccaccttcgcctggtcccaggaaagccctccctgcctccacagaataaacctcacggtgccccagggctgtctgctggctgttgtcggtccagygggggcagggaagtcctccctgctgtccgccctccttggggagctgtcaaaggtggaggggttcgtgagcatcgagggtgctgtggcctacgtgccccag

SEQ ID NO: 11684 - DNA, 201 bp, Homo sapiens
tagctcatgccagctgagacgcttggagtcagccagctactcgtctgtctgctcccacatggctgagacgttccagggcagcacagtggtccgggcattcygaacccaggccccctttgtggctcagaacaatgctcgcgtagatgaaagccagaggatcagtttcccgcgactggtggctgacaggtggcttgcggccaa

SEQ ID NO: 11685 - DNA, 201 bp, Homo sapiens
ggcctggtgggctactccagggaacaacacggattctcgtgacgcacgcactccacatcctgccccaggctgattggatcatagtgctggcaaatggggcyatcgcagagatgggttcctaccaggagcttctgcagaggaagggggccctcgtgtgtcttctggatcaagccagacagccaggagatagaggagaaggag

SEQ ID NO: 11686 - DNA, 201 bp, Homo sapiens
caggctttcctgcccttctccatccactccctcgtccaggcccgggtgtcctttgaccgtctggtcaccttcctctgcctggaagaagttgaccctggtgycgtagactcaagttcctctggaagcgctgccgggaaggattgcatcacgatacaaagtgccaccttcgcctggtcccaggaaagccctccctgcctccac

SEQ ID NO: 11687 - DNA, 201 bp, Homo sapiens
ggactcacgggcacggctcaccagctctatcctcaggaactcgaagaccatcaagttccatggctgggagggagcctttctggacagagtcctgggcatcygaggccaggagctgggcgccttgcggacctccggcctcctcttctctgtgtcgctggtgtccttccaagtgtctacatttctggtcgcactggtggtgtt

SEQ ID NO: 11688 - DNA, 201 bp, Homo sapiens
aatgaggcagaaggactcacgggcacggctcaccagctctatcctcaggaactcgaagaccatcaagttccatggctgggagggagcctttctggacagartcctgggcatccgaggccaggagctgggcgccttgcggacctccggcctcctcttctctgtgtcgctggtgtccttccaagtgtctacatttctggtcgc

SEQ ID NO: 11689 - DNA, 201 bp, Homo sapiens; identical to SEQ ID NO: 11663

SEQ ID NO: 11690 - DNA, 201 bp, Homo sapiens; identical to SEQ ID NO: 11662

SEQ ID NO: 11691 - DNA, 201 bp, Homo sapiens
ccagatgtggacagcttccctgagggaatccacacttcaattggggagcagggcatgaatctctccggaggccagaagcagcggctgagcctggcccgggmtgtatacagaaaggcagctgtgtacctgctggatgaccccctggcggccctggatgcccacgttggccagcatgtcttcaaccaggtcattgggcctggt

SEQ ID NO: 11692 - DNA, 201 bp, Homo sapiens
tatacagaaaggcagctgtgtacctgctggatgaccccctggcggccctggatgcccacgttggccagcatgtcttcaaccaggtcattgggcctggtggrctactccagggaacaacacggattctcgtgacgcacgcactccacatcctgccccaggctgattggatcatagtgctggcaaatggggccatcgcagaga

SEQ ID NO: 11693 - DNA, 201 bp, Homo sapiens
agagaatgtgtgcttcgggcaggagctggacccaccctggctggagagagtactagaagcctgtgccctgcagccagatgtggacagcttccctgagggartccacacttcaattggggagcagggcatgaatctctccggaggccagaagcagcggctgagcctggcccgggctgtatacagaaaggcagctgtgtacct

SEQ ID NO: 11694 - DNA, 201 bp, Homo sapiens
tccctgagaaggaccgtaccacttcagaagcccagacagaggttcctctggatgaccctgacagggcaggatggccagcaggaaaggacagcatccaatayggcagggtgaaggccacagtgcacctggcctacctgcgtgccgtgggcacccccctctgcctctacgcactcttcctcttcctctgccagcaagtggcct

SEQ ID NO: 11695 - DNA, 201 bp, Homo sapiens
agaacctgggaccagcaccaaggaccccagaggcacctctgcaggcaggaggcccgagcttagacgcgagaggtccatcaagtcagtccctgagaaggacbgtaccacttcagaagcccagacagaggttcctctggatgaccctgacagggcaggatggccagcaggaaaggacagcatccaatacggcagggtgaaggc

SEQ ID NO: 11696 - DNA, 201 bp, Homo sapiens; identical to SEQ ID NO: 11668

SEQ ID NO: 11697 - DNA, 201 bp, Homo sapiens; identical to SEQ ID NO: 11667

SEQ ID NO: 11698 - DNA, 201 bp, Homo sapiens
tatgtggttagctcatgccagctgagacgcttggagtcagccagctactcgtctgtctgctcccacatggctgagacgttccagggcagcacagtggtccvggcattccgaacccaggccccctttgtggctcagaacaatgctcgcgtagatgaaagccagaggatcagtttcccgcgactggtggctgacaggtggctt

SEQ ID NO: 11699 - DNA, 201 bp, Homo sapiens; identical to SEQ ID NO: 11670

SEQ ID NO: 11700 - DNA, 163 bp, Homo sapiens
cgccaggtcctggctctgtccagcggctccagaaaggccagtgcggtgggtgatgtggtcaabctggtgtccgtagacgtgcagcggctgaccgagagcgtcctctacctcaacgggctgtggctgcctctcgtctggatcgtggtctgcttcgtctatctct

SEQ ID NO: 11701 - DNA, 201 bp, Homo sapiens
gtatgtggttagctcatgccagctgagacgcttggagtcagccagctactcgtctgtctgctcccacatggctgagacgttccagggcagcacagtggtcygggcattccgaacccaggccccctttgtggctcagaacaatgctcgcgtagatgaaagccagaggatcagtttcccgcgactggtggctgacaggtggct

SEQ ID NO: 11702 - DNA, 201 bp, Homo sapiens
gactcacgggcacggctcaccagctctatcctcaggaactcgaagaccatcaagttccatggctgggagggagcctttctggacagagtcctgggcatccraggccaggagctgggcgccttgcggacctccggcctcctcttctctgtgtcgctggtgtccttccaagtgtctacatttctggtcgcactggtggtgttt

SEQ ID NO: 11703 - DNA, 201 bp, Homo sapiens
tcgctggtgtccttccaagtgtctacatttctggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggcccgggtgtcctttgaccgtctg

SEQ ID NO: 11704 - DNA, 201 bp, Homo sapiens
caggaaagccctccctgcctccacagaataaacctcacggtgccccagggctgtctgctggctgttgtcggtccagtgggggcagggaagtcctccctgcygtccgccctccttggggagctgtcaaaggtggaggggttcgtgagcatcgagggtgctgtggcctacgtgccccaggaggcctgggtgcagaacacctct

SEQ ID NO: 11705 - DNA, 201 bp, Homo sapiens
cagccagatgtggacagcttccctgagggaatccacacttcaattggggagcagggcatgaatctctccggaggccagaagcagcggctgagcctggcccrggctgtatacagaaaggcagctgtgtacctgctggatgaccccctggcggccctggatgcccacgttggccagcatgtcttcaaccaggtcattgggcct

SEQ ID NO: 11706 - DNA, 201 bp, Homo sapiens; identical to SEQ ID NO: 11677

SEQ ID NO: 11707 - DNA, 201 bp, Homo sapiens
ggagctggacccaccctggctggagagagtactagaagcctgtgccctgcagccagatgtggacagcttccctgagggaatccacacttcaattggggagyagggcatgaatctctccggaggccagaagcagcggctgagcctggcccgggctgtatacagaaaggcagctgtgtacctgctggatgaccccctggcggc

SEQ ID NO: 11708 - DNA, 201 bp, Homo sapiens; identical to SEQ ID NO: 11661

SEQ ID NO: 11709 - DNA, 201 bp, Homo sapiens; identical to SEQ ID NO: 11664

SEQ ID NO: 11710 - DNA, 201 bp, Homo sapiens; identical to SEQ ID NO: 11665

SEQ ID NO: 11711 - DNA, 201 bp, Homo sapiens
agcggctgaccgagagcgtcctctacctcaacgggctgtggctgcctctcgtctggatcgtggtctgcttcgtctatctctggcagctcctggggccctcygccctcactgccatcgctgtcttcctgagcctcctccctctgaatttcttcatctccaagaaaaggaaccaccatcaggaggagcaaatgaggcagaagg

SEQ ID NO: 11712 - DNA, 201 bp, Homo sapiens
tagacgtgcagcggctgaccgagagcgtcctctacctcaacgggctgtggctgcctctcgtctggatcgtggtctgcttcgtctatctctggcagctcctrgggccctccgccctcactgccatcgctgtcttcctgagcctcctccctctgaatttcttcatctccaagaaaaggaaccaccatcaggaggagcaaatga

SEQ ID NO: 11713 - DNA, 175 bp, Homo sapiens
cgccaggtcctggctctgtccagcggctccagaaaggccagtgcggtgggtgatgtggtcaacctggtgtccgtrgacgtgcagcggctgaccgagagcgtcctctacctcaacgggctgtggctgcctctcgtctggatcgtggtctgcttcgtctatctctggcagctcctgg

SEQ ID NO: 11714 - DNA, 201 bp, Homo sapiens
accctgacagggcaggatggccagcaggaaaggacagcatccaatacggcagggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtg

SEQ ID NO: 11715 - DNA, 201 bp, Homo sapiens
ctctacgctgggtttcagagcctgtatgtggttagctcatgccagctgagacgcttggagtcagccagctactcgtctgtctgctcccacatggctgagaygttccagggcagcacagtggtccgggcattccgaacccaggccccctttgtggctcagaacaatgctcgcgtagatgaaagccagaggatcagtttcccg

SEQ ID NO: 11716 - DNA, 201 bp, Homo sapiens
tggacagcttccctgagggaatccacacttcaattggggagcagggcatgaatctctccggaggccagaagcagcggctgagcctggcccgggctgtatamagaaaggcagctgtgtacctgctggatgaccccctggcggccctggatgcccacgttggccagcatgtcttcaaccaggtcattgggcctggtgggctac

SEQ ID NO: 11717 - DNA, 201 bp, Homo sapiens
tctccaagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaact

SEQ ID NO: 11718 - DNA, 201 bp, Homo sapiens
actgtggccatcctgccactgtttctcctctacgctgggtttcagagcctgtatgtggttagctcatgccagctgagacgcttggagtcagccagctactsgtctgtctgctcccacatggctgagacgttccagggcagcacagtggtccgggcattccgaacccaggccccctttgtggctcagaacaatgctcgcgta

SEQ ID NO: 11719 - DNA, 201 bp, Homo sapiens
ctgtggcctacgtgccccaggaggcctgggtgcagaacacctctgtggtagagaatgtgtgcttcgggcaggagctggacccaccctggctggagagagtwctagaagcctgtgccctgcagccagatgtggacagcttccctgagggaatccacacttcaattggggagcagggcatgaatctctccggaggccagaagc

SEQ ID NO: 11720 - DNA, 201 bp, Homo sapiens; identical to SEQ ID NO: 11671

SEQ ID NO: 11721 - DNA, 201 bp, Homo sapiens
ggtgctgtggcctacgtgccccaggaggcctgggtgcagaacacctctgtggtagagaatgtgtgcttcgggcaggagctggacccaccctggctggagaragtactagaagcctgtgccctgcagccagatgtggacagcttccctgagggaatccacacttcaattggggagcagggcatgaatctctccggaggccag

SEQ ID NO: 11722 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcagagcctgtatgtggttagctcatgccagctgagacgcttggagtcagccagctactcgtctgtctgctcccacatggctgagac

SEQ ID NO: 11723 - DNA, 201 bp, Homo sapiens; identical to SEQ ID NO: 11672

SEQ ID NO: 11724 - DNA, 201 bp, Homo sapiens
ccacatcctgccccaggctgattggatcatagtgctggcaaatggggccatcgcagagatgggttcctaccaggagcttctgcagaggaagggggccctcrtgtgtcttctggatcaagccagacagccaggagatagaggagaaggagaaacagaacctgggaccagcaccaaggaccccagaggcacctctgcaggcag

SEQ ID NO: 11725 - DNA, 201 bp, Homo sapiens; identical to SEQ ID NO: 11673

SEQ ID NO: 11726 - DNA, 201 bp, Homo sapiens
gctgtctgctggctgttgtcggtccagtgggggcagggaagtcctccctgctgtccgccctccttggggagctgtcaaaggtggaggggttcgtgagcatygagggtgctgtggcctacgtgccccaggaggcctgggtgcagaacacctctgtggtagagaatgtgtgcttcgggcaggagctggacccaccctggctgg

SEQ ID NO: 11727 - DNA, 201 bp, Homo sapiens; identical to SEQ ID NO: 11674

SEQ ID NO: 11728 - DNA, 201 bp, Homo sapiens; identical to SEQ ID NO: 11675

SEQ ID NO: 11729 - DNA, 201 bp, Homo sapiens; identical to SEQ ID NO: 11676

SEQ ID NO: 11730 - DNA, 201 bp, Homo sapiens; identical to SEQ ID NO: 11678

SEQ ID NO: 11731 - DNA, 201 bp, Homo sapiens; identical to SEQ ID NO: 11680

SEQ ID NO: 11732 - DNA, 201 bp, Homo sapiens; identical to SEQ ID NO: 11682

SEQ ID NO: 11733 - DNA, 201 bp, Homo sapiens; identical to SEQ ID NO: 11683

SEQ ID NO: 11734 - DNA, 201 bp, Homo sapiens; identical to SEQ ID NO: 11685

SEQ ID NO: 11735 - DNA, 201 bp, Homo sapiens; identical to SEQ ID NO: 11686

SEQ ID NO: 11736 - DNA, 201 bp, Homo sapiens; identical to SEQ ID NO: 11687

SEQ ID NO: 11737 - DNA, 201 bp, Homo sapiens; identical to SEQ ID NO: 11707

SEQ ID NO: 11738 - DNA, 201 bp, Homo sapiens; identical to SEQ ID NO: 11688

SEQ ID NO: 11739 - DNA, 201 bp, Homo sapiens; identical to SEQ ID NO: 11691

SEQ ID NO: 11740 - DNA, 201 bp, Homo sapiens; identical to SEQ ID NO: 11711

SEQ ID NO: 11741 - DNA, 175 bp, Homo sapiens; identical to SEQ ID NO: 11713

SEQ ID NO: 11742 - DNA, 201 bp, Homo sapiens; identical to SEQ ID NO: 11712

SEQ ID NO: 11743 - DNA, 201 bp, Homo sapiens; identical to SEQ ID NO: 11692

SEQ ID NO: 11744 - DNA, 201 bp, Homo sapiens; identical to SEQ ID NO: 11693

SEQ ID NO: 11745 - DNA, 201 bp, Homo sapiens; identical to SEQ ID NO: 11716

SEQ ID NO: 11746 - DNA, 201 bp, Homo sapiens; identical to SEQ ID NO: 11719

SEQ ID NO: 11747 - DNA, 201 bp, Homo sapiens; identical to SEQ ID NO: 11721

SEQ ID NO: 11748 - DNA, 163 bp, Homo sapiens; identical to SEQ ID NO: 11700

SEQ ID NO: 11749 - DNA, 201 bp, Homo sapiens
ccacatcctgccccaggctgattggatcatagtgctggcaaatggggccatcgcagagatgggttcctaccaggagcttctgcagaggaagggggccctcrtgtgtcttctggatcaagccagacagccaggagatagaggagaaggaggtactaggtgggctttgctgattctccaggcctggctcctgccacccttggg

SEQ ID NO: 11750 - DNA, 201 bp, Homo sapiens; identical to SEQ ID NO: 11702

SEQ ID NO: 11751 - DNA, 201 bp, Homo sapiens; identical to SEQ ID NO: 11726

SEQ ID NO: 11752 - DNA, 201 bp, Homo sapiens; identical to SEQ ID NO: 11703

SEQ ID NO: 11753 - DNA, 201 bp, Homo sapiens; identical to SEQ ID NO: 11704

SEQ ID NO: 11754 - DNA, 201 bp, Homo sapiens; identical to SEQ ID NO: 11705

SEQ ID NO: 11755 - DNA, 201 bp, Homo sapiens
gaggtgctctggctggtccactctctaaggctggagaagggagaccaggatggtacttgaacgtcccagggatgctgtcccatcccttccttcctcactcytactctttgaccctgatggccaaagccagagacgcaggccctaaaggtaaaaacgtcctctctgtattctctggcttttactccctagtgtctctgcata

SEQ ID NO: 11756 - DNA, 201 bp, Homo sapiens
cacctgcggcccggatatcagccctcaacattgtgggagacctactgcggaaagtcggggcactggagtccaaactcgcttcctgccggaacctcgtgtaygatcagtccccaaaccgaacaggtggcccagcctctgggcggagcagcaagaacagagatggcggggagagacggccaagcagcaccagcgtgcctttgg

SEQ ID NO: 11757 - DNA, 201 bp, Homo sapiens
cttcttcttcgagtcggagagctacaaggacagcgtccagggtagggtgagagggggaccatgaatggcccctgtccctggccccacagactctgagaagsgaagaccatgtctcctcgttggagaaacccaatagcaggggaagctggggggtcaagcaccatcgcaccaacactccaccgcgatctgcctgcgggggat

SEQ ID NO: 11758 - DNA, 201 bp, Homo sapiens
ttagtcaaagcctctagaaggggatcctcgttgaaaggagccctttttactcaaaacacatgggctagtacttgaggtgttcactgattgagaaaataccsgtgaggtatgggactctgataaaaaaaaaaaaaaacacacacacacacaaaaaaaacagaatctgtggcttgaagggaactccgtcacctatgagttggg

SEQ ID NO: 11759 - DNA, 201 bp, Homo sapiens
ttccagagcttccacggtgctggcaaagtcctgcagcttcttcttcgagtcggagagctacaaggacagcgtccagggtagggtgagagggggaccatgartggcccctgtccctggccccacagactctgagaagcgaagaccatgtctcctcgttggagaaacccaatagcaggggaagctggggggtcaagcaccatc

SEQ ID NO: 11760 - DNA, 201 bp, Homo sapiens
atctcctcgtccagctggtcttgcaggctgttccgctcctcctccagctggcgcagcttcgtagacacgttgagcttctgccgggtttcttcttgaagcarctcctgcaaaagggatgcaaagaggtcccagggacctgccccgaggaaggccaccccccaggtcccctggatgatgtggcaggacactcacctgggtgtc

SEQ ID NO: 11761 - DNA, 201 bp, Homo sapiens
tcaaaacacatgggctagtacttgaggtgttcactgattgagaaaatacccgtgaggtatgggactctgataaaaaaaaaaaaaaacacacacacacacamaaaaaacagaatctgtggcttgaagggaactccgtcacctatgagttgggaccctggccctagactctgtggttctaagaacttatttgagccccaatgg

SEQ ID NO: 11762 - DNA, 201 bp, Homo sapiens
gagagggggaccatgaatggcccctgtccctggccccacagactctgagaagcgaagaccatgtctcctcgttggagaaacccaatagcaggggaagctgrggggtcaagcaccatcgcaccaacactccaccgcgatctgcctgcgggggatctcagcgcagagaagttgagaggacccatgaaggaagcaaggacacgg

SEQ ID NO: 11763 - DNA, 201 bp, Homo sapiens
tgattgagaaaatacccgtgaggtatgggactctgataaaaaaaaaaaaaaacacacacacacacaaaaaaaacagaatctgtggcttgaagggaactccrtcacctatgagttgggaccctggccctagactctgtggttctaagaacttatttgagccccaatggtattgactgggacctgatcccactaaatggatcc

SEQ ID NO: 11764 - DNA, 201 bp, Homo sapiens
cccagggacctgccccgaggaaggccaccccccaggtcccctggatgatgtggcaggacactcacctgggtgtcctggagctgggaactgagggacgccaygtccttggccagcttaatggccttcccctcggcctcgttaagcatccctgtgacgctctcaacttcattctaagggtgccaagagactggttagtcaaag

SEQ ID NO: 11765 - DNA, 201 bp, Homo sapiens
ataaggggttggacacgagttgccgctggttgtccaaatcaacaaccaggtcgtccagctcctgctgaagcctgttcttggtcttttccagtttatcatamgcggccgccttctcctcgtactgctgggtgaggttctcgatctccttctggaacctcttcttcccctcttccagagcttccacggtgctggcaaagtcct

SEQ ID NO: 11766 - DNA, 201 bp, Homo sapiens
cgcccattgctcaccgaggacccagctcaagtttaaacacacctgggagcttcagacgtggcctggacgactccaccggggggacccccctcacacctgcrgcccggatatcagccctcaacattgtgggagacctactgcggaaagtcggggcactggagtccaaactcgcttcctgccggaacctcgtgtacgatcagt

SEQ ID NO: 11767 - DNA, 201 bp, Homo sapiens; identical to SEQ ID NO: 11755

SEQ ID NO: 11768 - DNA, 201 bp, Homo sapiens; identical to SEQ ID NO: 11757

SEQ ID NO: 11769 - DNA, 201 bp, Homo sapiens; identical to SEQ ID NO: 11758

SEQ ID NO: 11770 - DNA, 201 bp, Homo sapiens; identical to SEQ ID NO: 11759

SEQ ID NO: 11771 - DNA, 201 bp, Homo sapiens; identical to SEQ ID NO: 11760

SEQ ID NO: 11772 - DNA, 201 bp, Homo sapiens; identical to SEQ ID NO: 11761

SEQ ID NO: 11773 - DNA, 201 bp, Homo sapiens; identical to SEQ ID NO: 11763

SEQ ID NO: 11774 - DNA, 201 bp, Homo sapiens; identical to SEQ ID NO: 11762

SEQ ID NO: 11775 - DNA, 201 bp, Homo sapiens; identical to SEQ ID NO: 11764

SEQ ID NO: 11776 - DNA, 201 bp, Homo sapiens
agtcggggttggacacgagttgccgctggttgtccaaatcaacaaccaggtcgtccagctcctgctgaagcctgttcttggtcttttccagtttatcatamgcggccgccttctcctcgtactgctgggtgaggttctcgatctccttctggaacctcttcttcccctcttccagagcttccacggtgctggcaaagtcct

SEQ ID NO: 11777 - DNA, 201 bp, Homo sapiens
cgcccattgctcaccgaggacccagctcaagtttaaacacacctgggagcttcagacgtggcctggacgactccaccggggggacccccctcacacctgcrgcccggatatcagccctcaacattgtgggagacctactgcggaaagtcggggttggacacgagttgccgctggttgtccaaatcaacaaccaggtcgtcc

SEQ ID NO: 11778 - DNA, 201 bp, Homo sapiens; identical to SEQ ID NO: 11755

SEQ ID NO: 11779 - DNA, 201 bp, Homo sapiens; identical to SEQ ID NO: 11756

SEQ ID NO: 11780 - DNA, 201 bp, Homo sapiens; identical to SEQ ID NO: 11757

SEQ ID NO: 11781 - DNA, 201 bp, Homo sapiens; identical to SEQ ID NO: 11758

SEQ ID NO: 11782 - DNA, 201 bp, Homo sapiens; identical to SEQ ID NO: 11759

SEQ ID NO: 11783 - DNA, 201 bp, Homo sapiens; identical to SEQ ID NO: 11760

SEQ ID NO: 11784 - DNA, 201 bp, Homo sapiens; identical to SEQ ID NO: 11761

SEQ ID NO: 11785 - DNA, 201 bp, Homo sapiens; identical to SEQ ID NO: 11762

SEQ ID NO: 11786 - DNA, 201 bp, Homo sapiens; identical to SEQ ID NO: 11763

SEQ ID NO: 11787 - DNA, 201 bp, Homo sapiens; identical to SEQ ID NO: 11764

SEQ ID NO: 11788 - DNA, 201 bp, Homo sapiens; identical to SEQ ID NO: 11765

SEQ ID NO: 11789 - DNA, 201 bp, Homo sapiens; identical to SEQ ID NO: 11766

SEQ ID NO: 11790 - DNA, 201 bp, Homo sapiens
ctagggctgatactggcttctacttctgtgaggtgcagaacgtccatggcagcgagcgctcgggccctgtcagcgtggtagtcaaccacccgcctctcacyccagtcctgacagccttcctggagacccaggcgggacttgtgggcatccttcactgctctgtggtcagtgagcccctggccacactggtgctgtcacatg

SEQ ID NO: 11791 - DNA, 201 bp, Homo sapiens
ggacgtgcctgagggcgctgccctgaacctcagctgccgcctcctgggtggccctgggcctgtgggcaactccacctttgcatggttctggaatgaccggyggctgcacgcggagcctgtgcccactctcgccttcacccacgtggctcgtgctcaagctgggatgtaccactgcctggctgagctccccactggggctgc

SEQ ID NO: 11792 - DNA, 201 bp, Homo sapiens
cacccacactctatacttggtaccacaacggtcgttggctgcaggagggtccagctgcctcactctcattcctggtggccacgcgggctcatgcaggcgcytactcttgccaggcccaggatgcccagggcacccgcagctcccgtcctgctgccctgcaagtcctctatgcccctcaggacgctgtcctgtcctccttcc

SEQ ID NO: 11793 - DNA, 201 bp, Homo sapiens
tgacactgctgcccgtggccagaactgatgctgccctttacgcctgccgcatcctgactgaggctggtgcccagctctccactcccgtgctcctgagtgtmctctatcccccggaccgtccaaagctgtcagccctcctagacatgggccagggccacatggctctgttcatctgcactgtggacagccgccccctggcct

SEQ ID NO: 11794 - DNA, 201 bp, Homo sapiens
tgaggagcgaagagccctctgctctaggatttgggttgaaaaacagagagagaagtggggagttgccacaggagctaacacgctgggaggcagttgggggccgggtgaactttgtgtagccgaggccgcaccctccctcattccaggctcattcattttcatgctccattgccagactcttgctgggagcccgtccagaat

SEQ ID NO: 11795 - DNA, 201 bp, Homo sapiens
acagccgccccctggccttgctggccttgttccatggggagcacctcctggccaccagcctgggtccccaggtcccatcccatggtcggttccaggctaargctgaggccaactccctgaagttagaggtccgagaactgggccttggggactctggcagctaccgctgtgaggccacaaatgttcttggatcatccaaca

SEQ ID NO: 11796 - DNA, 201 bp, Homo sapiens
tgcagaacgtccatggcagcgagcgctcgggccctgtcagcgtggtagtcaaccacccgcctctcaccccagtcctgacagccttcctggagacccaggcrggacttgtgggcatccttcactgctctgtggtcagtgagcccctggccacactggtgctgtcacatgggggtcatatcctggcctccacctccggggaca

SEQ ID NO: 11797 - DNA, 201 bp, Homo sapiens
aggtcaccaaagcccccaacttgctgcgtgtggagattcacaaccctttgctggaagaggagggcttgtacctctgtgaggccagcaatgccctgggcaaygcctccacctcagccaccttcaatggccaggccactgtcctggccattgcaccatcacacacacttcaggagggcacagaagccaacttgacttgcaacg

SEQ ID NO: 11798 - DNA, 157 bp, Homo sapiens
atgggcttcttgcccaagcttctcctcctggcctcattcttcccagcaggccaggcytcatggggcgtctccagtccccaggacgtgcagggtgtgaaggggtcttgcctgcttatcccctgcatcttcagcttccctgccgacgtggaggtgcccg

SEQ ID NO: 11799 - DNA, 201 bp, Homo sapiens
ccggcggctgcacgcggagcctgtgcccactctcgccttcacccacgtggctcgtgctcaagctgggatgtaccactgcctggctgagctccccactgggsctgctgcctctgctccagtcatgctccgtgtgctctaccctcccaagacgcccaccatgatggtcttcgtggagcctgagggtggcctccggggcatcct

SEQ ID NO: 11800 - DNA, 201 bp, Homo sapiens
cgaggactctggttcctacaacttccgcttcgagatcagtgaggtcaaccgctggtcagatgtgaaaggcaccttggtcacagtaacagaggagcccaggstgcccaccattgcctccccggtggagcttctcgagggcacagaggtggacttcaactgctccactccctacgtatgcctgcaggagcaggtcagactgca

SEQ ID NO: 11801 - DNA, 201 bp, Homo sapiens
ctccctacgtatgcctgcaggagcaggtcagactgcagtggcaaggccaggaccctgctcgctctgtcaccttcaacagccagaagtttgagcccaccggygtcggccacctggagaccctccacatggccatgtcctggcaggaccacggccggatcctgcgctgccagctctccgtggccaatcacagggctcagagcg

SEQ ID NO: 11802 - DNA, 201 bp, Homo sapiens
ctgctcgctctgtcaccttcaacagccagaagtttgagcccaccggcgtcggccacctggagaccctccacatggccatgtcctggcaggaccacggccgkatcctgcgctgccagctctccgtggccaatcacagggctcagagcgagattcacctccaagtgaagtatgcccccaagggtgtgaagatcctcctcagcc

SEQ ID NO: 11803 - DNA, 201 bp, Homo sapiens
ccctatctcatgatggcaaggtgctggccacgagcagcggggtccacagcttggcatcagggacaggccatgtccaggtggcccgaaacgccctacggctrcaggtgcaagatgtgcctgcaggtgatgacacctatgtttgcacagcccaaaacttgctgggctcaatcagcaccatcgggcggttgcaggtagaaggtg

SEQ ID NO: 11804 - DNA, 201 bp, Homo sapiens
cccctcaggacgctgtcctgtcctccttccgggactccagggccagatccatggctgtgatacagtgcactgtggacagtgagccacctgctgagctggcyctatctcatgatggcaaggtgctggccacgagcagcggggtccacagcttggcatcagggacaggccatgtccaggtggcccgaaacgccctacggctgc

SEQ ID NO: 11805 - DNA, 201 bp, Homo sapiens
gcctggacgtgcctgagggcgctgccctgaacctcagctgccgcctcctgggtggccctgggcctgtgggcaactccacctttgcatggttctggaatgaycggcggctgcacgcggagcctgtgcccactctcgccttcacccacgtggctcgtgctcaagctgggatgtaccactgcctggctgagctccccactgggg

SEQ ID NO: 11806 - DNA, 201 bp, Homo sapiens
aggtgaacagcagctaccctgcagtcagttccattaagtggctcaaggatggggtacgcctccaaaccaagactggtgtgctgcacctgccccaggcagcmtggagcgatgctggcgtctacacctgccaagctgagaacggcgtgggctctttggtctcaccccccatcagcctccacatcttcatggctgaggtccagg

SEQ ID NO: 11807 - DNA, 201 bp, Homo sapiens
agcttctcgagggcacagaggtggacttcaactgctccactccctacgtatgcctgcaggagcaggtcagactgcagtggcaaggccaggaccctgctcgmtctgtcaccttcaacagccagaagtttgagcccaccggcgtcggccacctggagaccctccacatggccatgtcctggcaggaccacggccggatcctgc

SEQ ID NO: 11808 - DNA, 201 bp, Homo sapiens
cgcgggctcatgcaggcgcctactcttgccaggcccaggatgcccagggcacccgcagctcccgtcctgctgccctgcaagtcctctatgcccctcaggaygctgtcctgtcctccttccgggactccagggccagatccatggctgtgatacagtgcactgtggacagtgagccacctgctgagctggccctatctcatg

SEQ ID NO: 11809 - DNA, 201 bp, Homo sapiens
acttggccactagggctgatactggcttctacttctgtgaggtgcagaacgtccatggcagcgagcgctcgggccctgtcagcgtggtagtcaaccacccrcctctcaccccagtcctgacagccttcctggagacccaggcgggacttgtgggcatccttcactgctctgtggtcagtgagcccctggccacactggtgc

SEQ ID NO: 11810 - DNA, 201 bp, Homo sapiens
caggagggtccagctgcctcactctcattcctggtggccacgcgggctcatgcaggcgcctactcttgccaggcccaggatgcccagggcacccgcagctmccgtcctgctgccctgcaagtcctctatgcccctcaggacgctgtcctgtcctccttccgggactccagggccagatccatggctgtgatacagtgcact

SEQ ID NO: 11811 - DNA, 201 bp, Homo sapiens
agatccgagacctggaggaaactgacagtggggagtacaagtgctcagccaccaactcccttggaaatgcaacctctaccctggacttccatgccaatgcygcccgtctcctcatcagcccggcagccgaggtggtggaaggacaggcagtgacactgagctgcagaagcggcctaagccccacacctgatgcccgcttct

SEQ ID NO: 11812 - DNA, 201 bp, Homo sapiens
gggcacccgcagctcccgtcctgctgccctgcaagtcctctatgcccctcaggacgctgtcctgtcctccttccgggactccagggccagatccatggctrtgatacagtgcactgtggacagtgagccacctgctgagctggccctatctcatgatggcaaggtgctggccacgagcagcggggtccacagcttggcatc

SEQ ID NO: 11813 - DNA, 201 bp, Homo sapiens
ggctggaccttgatgccgctggggccggggctggacggcgaggcctccttttgtgccgtgtggacagcgacccccccgccaggctgcagctgctccacaargaccgtgttgtggccacttccctgccatcagggggtggctgcagcacctgtgggggctgttccccacgcatgaaggtcaccaaagcccccaacttgctgc

SEQ ID NO: 11814 - DNA, 201 bp, Homo sapiens
tatatctgtgaggcctccaacaccctgggccaggcctcggcctcagctgacttcgacgctcaagctgtgaatgtgcaggtgtggcccggggctaccgtgcrggaggggcagctggtgaacctgacctgccttgtgtggaccactcacccggcccagctcacctacacatggtaccaggatgggcagcagcgcctggatgcc

SEQ ID NO: 11815 - DNA, 201 bp, Homo sapiens
tggagctgcggctggagggtgtgcgggtgatcctggctccggaggctgccgtgcctgaaggtgcccccatcacagtgacctgtgcggaccctgctgcccaygcacccacactctatacttggtaccacaacggtcgttggctgcaggagggtccagctgcctcactctcattcctggtggccacgcgggctcatgcaggcg

SEQ ID NO: 11816 - DNA, 201 bp, Homo sapiens
agtgggctagtgactccccctgcagcctggtggagatggtgtgaggagcgaagagccctctgctctaggatttgggttgaaaaacagagagagaagtgggragttgccacaggagctaacacgctgggaggcagttgggggccgggtgaactttgtgtagccgaggccgcaccctccctcattccaggctcattcattttc

SEQ ID NO: 11817 - DNA, 201 bp, Homo sapiens
acctcggccacgctccgctttgcagccataactttgacacaagctggggcctatcattgccaagcccaggccccaggctcagccaccacgagcctagctgyacccatcagcctccacgtgtcctatgccccacgccacgtcacactcactaccctgatggacacaggccctggacgactgggcctcctcctgtgccgtgtg

SEQ ID NO: 11818 - DNA, 201 bp, Homo sapiens
cttcactgctctgtggtcagtgagcccctggccacactggtgctgtcacatgggggtcatatcctggcctccacctccggggacagtgatcacagcccacrcttcagtggtacctctggtcccaactccctgcgcctggagatccgagacctggaggaaactgacagtggggagtacaagtgctcagccaccaactccctt

SEQ ID NO: 11819 - DNA, 201 bp, Homo sapiens
aggccccaggctcagccaccacgagcctagctgcacccatcagcctccacgtgtcctatgccccacgccacgtcacactcactaccctgatggacacaggycctggacgactgggcctcctcctgtgccgtgtggacagtgaccctccggcccagctgcggctgctccacggggatcgccttgtggcctccaccctacaag

SEQ ID NO: 11820 - DNA, 201 bp, Homo sapiens
ccactcacccggcccagctcacctacacatggtaccaggatgggcagcagcgcctggatgcccactccatccccctgcccaacgtcacagtcagggatgcyacctcctaccgctgcggtgtgggcccccctggtcgggcaccccgcctctccagacctatcaccttggacgtcctctacgcgccccgcaacctgcgcctga

SEQ ID NO: 11821 - DNA, 201 bp, Homo sapiens
aacacctcactcttcttccaggtccgaggagcctgggtccaggtgtcaccatcacctgagctccaagagggccaggctgtggtcctgagctgccaggtacmcacaggagtcccagaggggacctcatatcgttggtatcgggatggccagcccctccaggagtcgacctcggccacgctccgctttgcagccataactttg

SEQ ID NO: 11822 - DNA, 201 bp, Homo sapiens
cagccagaagtttgagcccaccggcgtcggccacctggagaccctccacatggccatgtcctggcaggaccacggccggatcctgcgctgccagctctccrtggccaatcacagggctcagagcgagattcacctccaagtgaagtatgcccccaagggtgtgaagatcctcctcagcccctcggggaggaacatccttcc

SEQ ID NO: 11823 - DNA, 201 bp, Homo sapiens
atgtcctggcaggaccacggccggatcctgcgctgccagctctccgtggccaatcacagggctcagagcgagattcacctccaagtgaagtatgcccccargggtgtgaagatcctcctcagcccctcggggaggaacatccttccaggtgagctggtcacactcacctgccaggtgaacagcagctaccctgcagtcagt

SEQ ID NO: 11824 - DNA, 201 bp, Homo sapiens
cctgcgaatcagggaccaacaggagagagctcttgagtgggctagtgactccccctgcagcctggtggagatggtgtgaggagcgaagagccctctgctcyaggatttgggttgaaaaacagagagagaagtggggagttgccacaggagctaacacgctgggaggcagttgggggccgggtgaactttgtgtagccgagg

SEQ ID NO: 11825 - DNA, 201 bp, Homo sapiens
tcattgatcctgatgcagccacatgtgagacctcaacctgtgccccacccctgggctgaccagtggtgttgcctgccctccggaggagaaagtggccagamtctgtgatgactccagcctatgaatgtgaatgaggcagtgttgagtcctgcccgcctctacgaaaacagctctgtgacatctgactttttatgacctggc

SEQ ID NO: 11826 - DNA, 201 bp, Homo sapiens
cccccatcagcctccacatcttcatggctgaggtccaggtgagcccagcaggtcccatcctggagaaccagacagtgacactagtctgcaacacacccaaygaggcacccagtgatctccgctacagctggtacaagaaccatgtcctgctggaggatgcccactcccataccctccggctgcacttggccactagggctg

SEQ ID NO: 11827 - DNA, 201 bp, Homo sapiens
gcagacatccttgtgccagatttggcccctgaaagaagagatgccctcattcccaccaccaccccccctacccccagggactgggtactaccttactggcmcttacaagagtggagggcagacacagatgttgtcagcatccttattcctgctccagatgcatctctgttcatgactgtgtgagctcctgtccttttcctg

SEQ ID NO: 11828 - DNA, 201 bp, Homo sapiens
cccaggcgggacttgtgggcatccttcactgctctgtggtcagtgagcccctggccacactggtgctgtcacatgggggtcatatcctggcctccacctcyggggacagtgatcacagcccacgcttcagtggtacctctggtcccaactccctgcgcctggagatccgagacctggaggaaactgacagtggggagtaca

SEQ ID NO: 11829 - DNA, 201 bp, Homo sapiens
acatccatgtcctggcttcccccaatgccctgagggtggacatcgaggcgctgaggcccagcgaccaaggggaatacatctgttctgcctcaaatgtcctrggctctgcctctacctccacctactttggggtcagagccctgcaccgcctgcatcagttccagcagctgctctgggtcctgggactgctggtgggcctcc

SEQ ID NO: 11830 - DNA, 201 bp, Homo sapiens
ctggtcccaactccctgcgcctggagatccgagacctggaggaaactgacagtggggagtacaagtgctcagccaccaactcccttggaaatgcaacctcyaccctggacttccatgccaatgccgcccgtctcctcatcagcccggcagccgaggtggtggaaggacaggcagtgacactgagctgcagaagcggcctaa

SEQ ID NO: 11831 - DNA, 201 bp, Homo sapiens; identical to SEQ ID NO: 11790

SEQ ID NO: 11832 - DNA, 201 bp, Homo sapiens; identical to SEQ ID NO: 11791

SEQ ID NO: 11833 - DNA, 201 bp, Homo sapiens; identical to SEQ ID NO: 11792

SEQ ID NO: 11834 - DNA, 201 bp, Homo sapiens; identical to SEQ ID NO: 11793

SEQ ID NO: 11835 - DNA, 201 bp, Homo sapiens; identical to SEQ ID NO: 11795

SEQ ID NO: 11836 - DNA, 201 bp, Homo sapiens; identical to SEQ ID NO: 11796

SEQ ID NO: 11837 - DNA, 201 bp, Homo sapiens; identical to SEQ ID NO: 11799

SEQ ID NO: 11838 - DNA, 157 bp, Homo sapiens; identical to SEQ ID NO: 11798

SEQ ID NO: 11839 - DNA, 201 bp, Homo sapiens; identical to SEQ ID NO: 11797

SEQ ID NO: 11840 - DNA, 201 bp, Homo sapiens; identical to SEQ ID NO: 11800

SEQ ID NO: 11841 - DNA, 201 bp, Homo sapiens; identical to SEQ ID NO: 11801

SEQ ID NO: 11842 - DNA, 201 bp, Homo sapiens; identical to SEQ ID NO: 11802

SEQ ID NO: 11843 - DNA, 201 bp, Homo sapiens; identical to SEQ ID NO: 11803

SEQ ID NO: 11844 - DNA, 201 bp, Homo sapiens; identical to SEQ ID NO: 11804

SEQ ID NO: 11845 - DNA, 201 bp, Homo sapiens; identical to SEQ ID NO: 11805

SEQ ID NO: 11846 - DNA, 201 bp, Homo sapiens; identical to SEQ ID NO: 11806

SEQ ID NO: 11847 - DNA, 201 bp, Homo sapiens; identical to SEQ ID NO: 11807

SEQ ID NO: 11848 - DNA, 201 bp, Homo sapiens; identical to SEQ ID NO: 11808

SEQ ID NO: 11849 - DNA, 201 bp, Homo sapiens; identical to SEQ ID NO: 11809

SEQ ID NO: 11850 - DNA, 201 bp, Homo sapiens; identical to SEQ ID NO: 11810

SEQ ID NO: 11851 - DNA, 201 bp, Homo sapiens; identical to SEQ ID NO: 11811

SEQ ID NO: 11852 - DNA, 201 bp, Homo sapiens; identical to SEQ ID NO: 11812

SEQ ID NO: 11853 - DNA, 201 bp, Homo sapiens; identical to SEQ ID NO: 11813

SEQ ID NO: 11854 - DNA, 201 bp, Homo sapiens; identical to SEQ ID NO: 11814

SEQ ID NO: 11855 - DNA, 201 bp, Homo sapiens; identical to SEQ ID NO: 11815

SEQ ID NO: 11856 - DNA, 201 bp, Homo sapiens; identical to SEQ ID NO: 11817

SEQ ID NO: 11857 - DNA, 201 bp, Homo sapiens; identical to SEQ ID NO: 11818

SEQ ID NO: 11858 - DNA, 201 bp, Homo sapiens; identical to SEQ ID NO: 11819

SEQ ID NO: 11859 - DNA, 201 bp, Homo sapiens; identical to SEQ ID NO: 11820

SEQ ID NO: 11860 - DNA, 201 bp, Homo sapiens; identical to SEQ ID NO: 11821

SEQ ID NO: 11861 - DNA, 201 bp, Homo sapiens; identical to SEQ ID NO: 11822

SEQ ID NO: 11862 - DNA, 201 bp, Homo sapiens; identical to SEQ ID NO: 11823

SEQ ID NO: 11863 - DNA, 201 bp, Homo sapiens; identical to SEQ ID NO: 11826

SEQ ID NO: 11864 - DNA, 201 bp, Homo sapiens; identical to SEQ ID NO: 11828

SEQ ID NO: 11865 - DNA, 191 bp, Homo sapiens
acatccatgtcctggcttcccccaatgccctgagggtggacatcgaggcgctgaggcccagcgaccaaggggaatacatctgttctgcctcaaatgtcctrggctctgcctctacctccacctactttggggtcagaggtgaggggagggggctccatctcccaggccactctgcacaaaagcccagctct

SEQ ID NO: 11866 - DNA, 201 bp, Homo sapiens; identical to SEQ ID NO: 11830

SEQ ID NO: 11867 - DNA, 201 bp, Homo sapiens
ctaggctgcacacacccccactttcctctaccaggccacaccggaggcagtgctcacacaggcaagctaccaggccacaacaacgacacccacctcacctytggcacctctgagcatccacgtacttgcaagaactcttgctcacatcagctaagagattgcacctgctgacctagagattccggcctgtgctcctgtgct

SEQ ID NO: 11868 - DNA, 201 bp, Homo sapiens
gcagaacaagatgtccaggcactgcagcgggcagaaggacctagcagagaggaaacatgggtcccagtcttcacccagcgaaatcctgaacacctcatccragtgtttgatcagtaccagcggagcactgggcaagagctggaggaggctgtccagaaccgtttccatggagatgctcaggtggctctgctcggcctagct

SEQ ID NO: 11869 - DNA, 201 bp, Homo sapiens
acgaaacttccaggagcgcacccaacaggacctgatgaagtctctacaggcagcactttccggcaacctggagaggattgtgatggctctgctgcagcccrcagcccagtttgacgcccaggaattgaggacagctctgaaggcctcagattctgctgtggacgtggccattgaaattcttgccactcgaaccccacccca

SEQ ID NO: 11870 - DNA, 201 bp, Homo sapiens
gtggcatcttgcaggacctgctgttggccctggccaaggggggccgtgacagctactctggaatcattgactataatctggcagaacaagatgtccaggcmctgcagcgggcagaaggacctagcagagaggaaacatgggtcccagtcttcacccagcgaaatcctgaacacctcatccgagtgtttgatcagtaccagc

SEQ ID NO: 11871 - DNA, 201 bp, Homo sapiens
tgcaagaactcttgctcacatcagctaagagattgcacctgctgacctagagattccggcctgtgctcctgtgctgctgagcagggcaaccagtagcaccrtgtctgtgactggcgggaagatggcaccgtccctcacccaggagatcctcagccacctgggcctggccagcaagactgcagcgtgggggaccctgggcac

SEQ ID NO: 11872 - DNA, 201 bp, Homo sapiens
ctgactggctgttcagcctaggctgcacacacccccactttcctctaccaggccacaccggaggcagtgctcacacaggcaagctaccaggccacaacaaygacacccacctcacctctggcacctctgagcatccacgtacttgcaagaactcttgctcacatcagctaagagattgcacctgctgacctagagattccg

SEQ ID NO: 11873 - DNA, 201 bp, Homo sapiens
gtctgcatgtgggactctgtacagcccggtcctctcccacgtctgggaggggccagagtcagacaactgctgggttcgtccctaagagaggtcatctgackggctgttcagcctaggctgcacacacccccactttcctctaccaggccacaccggaggcagtgctcacacaggcaagctaccaggccacaacaacgacac

SEQ ID NO: 11874 - DNA, 201 bp, Homo sapiens
gcgcacccaacaggacctgatgaagtctctacaggcagcactttccggcaacctggagaggattgtgatggctctgctgcagcccacagcccagtttgacrcccaggaattgaggacagctctgaaggcctcagattctgctgtggacgtggccattgaaattcttgccactcgaaccccaccccagctgcaggagtgcct

SEQ ID NO: 11875 - DNA, 201 bp, Homo sapiens
cgtctgggaggggccagagtcagacaactgctgggttcgtccctaagagaggtcatctgactggctgttcagcctaggctgcacacacccccactttcctytaccaggccacaccggaggcagtgctcacacaggcaagctaccaggccacaacaacgacacccacctcacctctggcacctctgagcatccacgtacttg

SEQ ID NO: 11876 - DNA, 201 bp, Homo sapiens
gtggacgtggccattgaaattcttgccactcgaaccccaccccagctgcaggagtgcctggcagtctacaaacacaatttccaggtggaggctgtggatgrcatcacatctgagaccagtggcatcttgcaggacctgctgttggccctggccaaggggggccgtgacagctactctggaatcattgactataatctggca

SEQ ID NO: 11877 - DNA, 201 bp, Homo sapiens
tctgcatgtgggactctgtacagcccggtcctctcccacgtctgggaggggccagagtcagacaactgctgggttcgtccctaagagaggtcatctgactkgctgttcagcctaggctgcacacacccccactttcctctaccaggccacaccggaggcagtgctcacacaggcaagctaccaggccacaacaacgacacc

SEQ ID NO: 11878 - DNA, 201 bp, Homo sapiens
gagttcactcacatggattgaggcccagttcctgggagaagagatgctgggcaggaaggtgtctgcatgtgggactctgtacagcccggtcctctcccacrtctgggaggggccagagtcagacaactgctgggttcgtccctaagagaggtcatctgactggctgttcagcctaggctgcacacacccccactttcctct

SEQ ID NO: 11879 - DNA, 201 bp, Homo sapiens
gatactcgaattcttttggcaaacttcgctgttgtttgtgttccctgattgaaggttgggtggagcaggacatggaccgggaagaggcactggagttggargtgcctttgatgtgcacttggctattccgcaggaatcctgttttgccttagtgctacagtaatccacacccaggtctcccactccaggtctcccctcacc

SEQ ID NO: 11880 - DNA, 201 bp, Homo sapiens
acacacccccactttcctctaccaggccacaccggaggcagtgctcacacaggcaagctaccaggccacaacaacgacacccacctcacctctggcacctytgagcatccacgtacttgcaagaactcttgctcacatcagctaagagattgcacctgctgacctagagattccggcctgtgctcctgtgctgctgagcag

SEQ ID NO: 11881 - DNA, 201 bp, Homo sapiens
cttaacttaatttttcctgctgtatccagaagaaataattgtgtcatgattaatgtgtatttactgtactaattagaaaatatagtttgaggccgggcackgtggctcacgcctgtaatcccagtacttgggaggccaaggcaggcatatcaacttgaggccaggagttaaagagcagcctggctaacatggtgaaacccc

SEQ ID NO: 11882 - DNA, 201 bp, Homo sapiens
gccatggtgtctactatgaaccatcctgtactcagaatgtgaatcatggtgtacttgtggttggctatggtgatcttaatgggaaagaatactggcttgtkaaaaacagctggggccacaactttggtgaagaaggatatattcggatggcaagaaataaaggaaatcattgtgggattgctagctttccctcttacccag

SEQ ID NO: 11883 - DNA, 201 bp, Homo sapiens
cctgggagacatgaccagtgaagaagtgatgtctttgatgagttccctgagagttcccagccagtggcagagaaatatcacatataagtcaaaccctaatyggatattgcctgattctgtggactggagagagaaagggtgtgttactgaagtgaaatatcaaggttcttgtggtgcttgctgggctttcagtgctgtggg

SEQ ID NO: 11884 - DNA, 201 bp, Homo sapiens
gcacggtggctcacgcctgtaatcccagtacttgggaggccaaggcaggcatatcaacttgaggccaggagttaaagagcagcctggctaacatggtgaarccccatctctactaaaaatacaaaaaattagccgagcacggtggtgcatgcctgtaatcccagctacttgggaggctgaggcacgagattccttgaaccc

SEQ ID NO: 11885 - DNA, 201 bp, Homo sapiens
tactgaagtgaaatatcaaggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattga

SEQ ID NO: 11886 - DNA, 201 bp, Homo sapiens
tcatgtgacaagttccaatttcttttcaagtcaattgaactgaaatctccttgttgctttgaaatcttagaagagagcccactaattcaaggactcttacygtaggagcaactgctggttctatcacaatgaaacggctggtttgtgtgctcttggtgtgctcctctgcagtggcacagttgcataaagatcctaccctgg

SEQ ID NO: 11887 - DNA, 201 bp, Homo sapiens
tgtgacaagttccaatttcttttcaagtcaattgaactgaaatctccttgttgctttgaaatcttagaagagagcccactaattcaaggactcttactgtrggagcaactgctggttctatcacaatgaaacggctggtttgtgtgctcttggtgtgctcctctgcagtggcacagttgcataaagatcctaccctggatc

SEQ ID NO: 11888 - DNA, 201 bp, Homo sapiens
gtgatgcttcacaacctggagcattcaatgggaatgcactcatacgatctgggcatgaaccacctgggagacatgaccagtgaagaagtgatgtctttgaygagttccctgagagttcccagccagtggcagagaaatatcacatataagtcaaaccctaatcggatattgcctgattctgtggactggagagagaaaggg

SEQ ID NO: 11889 - DNA, 201 bp, Homo sapiens; identical to SEQ ID NO: 11881

SEQ ID NO: 11890 - DNA, 201 bp, Homo sapiens
gaagtggtgtctactatgaaccatcctgtactcagaatgtgaatcatggtgtacttgtggttggctatggtgatcttaatgggaaagaatactggcttgtkaaaaacagctggggccacaactttggtgaagaaggatatattcggatggcaagaaataaaggaaatcattgtgggattgctagctttccctcttacccag

SEQ ID NO: 11891 - DNA, 201 bp, Homo sapiens; identical to SEQ ID NO: 11883

SEQ ID NO: 11892 - DNA, 201 bp, Homo sapiens
tcaggtgatccacccaccccagcctcccaaagtgctaagattacaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgttttt

SEQ ID NO: 11893 - DNA, 201 bp, Homo sapiens; identical to SEQ ID NO: 11884

SEQ ID NO: 11894 - DNA, 201 bp, Homo sapiens; identical to SEQ ID NO: 11886

SEQ ID NO: 11895 - DNA, 201 bp, Homo sapiens; identical to SEQ ID NO: 11885

SEQ ID NO: 11896 - DNA, 201 bp, Homo sapiens
aatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagat

SEQ ID NO: 11897 - DNA, 201 bp, Homo sapiens
atgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatg

SEQ ID NO: 11898 - DNA, 201 bp, Homo sapiens
cagacgcttcctatccctacaaagccatggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtgtct

SEQ ID NO: 11899 - DNA, 201 bp, Homo sapiens; identical to SEQ ID NO: 11887

SEQ ID NO: 11900 - DNA, 201 bp, Homo sapiens
tgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgc

SEQ ID NO: 11901 - DNA, 201 bp, Homo sapiens
gccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgca

SEQ ID NO: 11902 - DNA, 201 bp, Homo sapiens; identical to SEQ ID NO: 11888

SEQ ID NO: 11903 - DNA, 201 bp, Homo sapiens
gccctatgacatttctacatcactggctgctcttcatcaaacctactataaaaaacattcaagttcaactgtttctttgggcctttatttccttatggagsccctcgtgtcgtgtaaaacttatattaaataaatgtgcatgcttttctcttgctaatctctcttttgttatagagatctcagccctaaacctaggatgga

SEQ ID NO: 11904 - DNA, 201 bp, Homo sapiens; identical to SEQ ID NO: 11890

SEQ ID NO: 11905 - DNA, 201 bp, Homo sapiens; identical to SEQ ID NO: 11883

SEQ ID NO: 11906 - DNA, 201 bp, Homo sapiens
atgattaatgtgtatttactgtactaattagaaaatatagtttgaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgttttt

SEQ ID NO: 11907 - DNA, 201 bp, Homo sapiens; identical to SEQ ID NO: 11885

SEQ ID NO: 11908 - DNA, 201 bp, Homo sapiens; identical to SEQ ID NO: 11886

SEQ ID NO: 11909 - DNA, 201 bp, Homo sapiens; identical to SEQ ID NO: 11896

SEQ ID NO: 11910 - DNA, 201 bp, Homo sapiens; identical to SEQ ID NO: 11897

SEQ ID NO: 11911 - DNA, 201 bp, Homo sapiens; identical to SEQ ID NO: 11898

SEQ ID NO: 11912 - DNA, 201 bp, Homo sapiens; identical to SEQ ID NO: 11887

SEQ ID NO: 11913 - DNA, 201 bp, Homo sapiens; identical to SEQ ID NO: 11900

SEQ ID NO: 11914 - DNA, 201 bp, Homo sapiens; identical to SEQ ID NO: 11901

SEQ ID NO: 11915 - DNA, 201 bp, Homo sapiens; identical to SEQ ID NO: 11888

SEQ ID NO: 11916 - DNA, 201 bp, Homo sapiens
cgtcggcggcacgtgcggggtcgtggacgacgagccccggccgactgggaaagcggagaccgaagacgaggacgaagggactgagggcgaggacgaagggsctcagtggtcgccgcaggacccggcactgcaaggcgtaggacagcccacaggaactggaagcataagaaagaagcgatttgtgtccagtcaccgctatgt

SEQ ID NO: 11917 - DNA, 201 bp, Homo sapiens
gcctcgccaccgccgccccaggggagaagccgccggcaccactacagttccacctcctgcggcggaatcggcagggcgacgtcggcggcacgtgcggggtsgtggacgacgagccccggccgactgggaaagcggagaccgaagacgaggacgaagggactgagggcgaggacgaaggggctcagtggtcgccgcaggacc

SEQ ID NO: 11918 - DNA, 201 bp, Homo sapiens
gttatctcatgagagctgtgatcctttaaagaaacctaaacatttcatagacttttgcacaatggcagaatgcagttaagtggtttaagtggtgttagctytgagggcaaggcaaagtgaggaagggctggtgcagggaaagcaagaaggctggagggatccagcgtatcttgccagtaaccagtgaggtgtatcagtaag

SEQ ID NO: 11919 - DNA, 201 bp, Homo sapiens
tgcccgccgccagcgagcgcctcgccaccgccgccccaggggagaagccgccggcaccactacagttccacctcctgcggcggaatcggcagggcgacgtmggcggcacgtgcggggtcgtggacgacgagccccggccgactgggaaagcggagaccgaagacgaggacgaagggactgagggcgaggacgaaggggctc

SEQ ID NO: 11920 - DNA, 201 bp, Homo sapiens
ctccaatgcagcgagctgtgcccgaggggttcggaaggcgcaagctgggcagcgacatggggaacgcggagcgggctccggggtctcggagctttgggccmgtacccacgctgctgctgctcgccgcggcgctactggccgtgtcggacgcactcgggcgcccctccgaggaggacgaggagctagtggtgccggagctgg

SEQ ID NO: 11921 - DNA, 201 bp, Homo sapiens
gcccagattccacctctgtctgtgtgcaaggacagtgtgtaaaagctggttgtgatcgcatcatagactccaaaaagaagtttgataaatgtggtgtttgygggggaaatggatctacttgtaaaaaaatatcaggatcagttactagtgcaaaacctggatatcatgatatcatcacaattccaactggagccaccaaca

SEQ ID NO: 11922 - DNA, 201 bp, Homo sapiens
caattccaactggagccaccaacatcgaagtgaaacagcggaaccagaggggatccaggaacaatggcagctttcttgccatcaaagctgctgatggcacrtatattcttaatggtgactacactttgtccaccttagagcaagacattatgtacaaaggtgttgtcttgaggtacagcggctcctctgcggcattggaaa

SEQ ID NO: 11923 - DNA, 201 bp, Homo sapiens
agattgttcaacatgagagaaaggctcagcaacgtgaaataacgcaaatggcttcctctttccttttttggaccatctcagtctttatttgtgtaattcaktttgaggaaaaaacaactccatgtatttattcaagtgcattaaagtctacaatggaaaaaaagcagtgaagcattagatgctggtaaaagctagaggaga

SEQ ID NO: 11924 - DNA, 201 bp, Homo sapiens
cggcaagtgtgtgaacaaaaccgacagaaagcattttgatacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaa

SEQ ID NO: 11925 - DNA, 201 bp, Homo sapiens
ctcgccgcggcgctactggccgtgtcggacgcactcgggcgcccctccgaggaggacgaggagctagtggtgccggagctggagcgcgccccgggacacgrgaccacgcgcctccgcctgcacgcctttgaccagcagctggatctggagctgcggcccgacagcagctttttggcgcccggcttcacgctccagaacgtg

SEQ ID NO: 11926 - DNA, 201 bp, Homo sapiens
atgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctggtccaacagtcgtatcctggtgaatgtctgttcagctcttctgtgagaat

SEQ ID NO: 11927 - DNA, 201 bp, Homo sapiens
atgggggtagatagaaaaggagttgaatcatcagagtaaactgccagttgcaaatttgataggatagttagtgaggattattaacctctgagcagtgatayagcataataaagccccgggcattattattattatttcttttgttacatctattacaagtttagaaaaaacaaagcaattgtcaaaaaaagttagaactat

SEQ ID NO: 11928 - DNA, 201 bp, Homo sapiens
agcaattgtcaaaaaaagttagaactattacaacccctgtttcctggtacttatcaaatacttagtatcatgggggttgggaaatgaaaagtaggagaaargtgagattttactaagacctgttttactttacctcactaacaatggggggagaaaggagtacaaataggatctttgaccagcactgtttatggctgctat

SEQ ID NO: 11929 - DNA, 201 bp, Homo sapiens
ctcagaatcccatacagctcccaggcgatctccctggcacctcgtacgatgccaaccggcagtgccagtttacatttggggaggactccaaacactgcccygatgcagccagcacatgtagcaccttgtggtgtaccggcacctctggtggggtgctggtgtgtcaaaccaaacacttcccgtgggcggatggcaccagct

SEQ ID NO: 11930 - DNA, 201 bp, Homo sapiens
agtgtgcaaaggaagtgaagccagccagcaccagaccttgtgcagaccatccctgcccccagtggcagctgggggagtggtcatcatgttctaagacctgygggaagggttacaaaaaaagaagcttgaagtgtctgtcccatgatggaggggtgttatctcatgagagctgtgatcctttaaagaaacctaaacatttca

SEQ ID NO: 11931 - DNA, 201 bp, Homo sapiens
accaacatcgaagtgaaacagcggaaccagaggggatccaggaacaatggcagctttcttgccatcaaagctgctgatggcacatatattcttaatggtgrctacactttgtccaccttagagcaagacattatgtacaaaggtgttgtcttgaggtacagcggctcctctgcggcattggaaagaattcgcagctttagc

SEQ ID NO: 11932 - DNA, 201 bp, Homo sapiens
gtcccagcagagccactctgcctgcgcctgcctctcagtgtctccaactttgcgctggaagaaaaacttcccgcgcgccggcagaactgcagcgcctcctyttagtgactccgggagcttcggctgtagccggctctgcgcgcccttccaacgaataatagaaattgttaattttaacaatccagagcaggccaacgaggc

SEQ ID NO: 11933 - DNA, 201 bp, Homo sapiens
gaggtgtgtagaacagggtcccacaggtttggggacattgagatcacttgtcttgtggtggggaggctgctgaggggtagcaggtccatctccagcagctkgtccaacagtcgtatcctggtgaatgtctgttcagctcttctgtgagaatatgattttttccatatgtatatagtaaaatatgttactataaattacatg

SEQ ID NO: 11934 - DNA, 201 bp, Homo sapiens
aagtgagattttactaagacctgttttactttacctcactaacaatggggggagaaaggagtacaaataggatctttgaccagcactgtttatggctgctrtggtttcagagaatgtttatacattatttctaccgagaattaaaacttcagattgttcaacatgagagaaaggctcagcaacgtgaaataacgcaaatgg

SEQ ID NO: 11935 - DNA, 201 bp, Homo sapiens
tagccggctctgcgcgcccttccaacgaataatagaaattgttaattttaacaatccagagcaggccaacgaggctttgctctcccgacccgaactaaagstccctcgctccgtgcgctgctacgagcggtgtctcctggggctccaatgcagcgagctgtgcccgaggggttcggaaggcgcaagctgggcagcgacatg

SEQ ID NO: 11936 - DNA, 201 bp, Homo sapiens; identical to SEQ ID NO: 11916

SEQ ID NO: 11937 - DNA, 201 bp, Homo sapiens; identical to SEQ ID NO: 11917

SEQ ID NO: 11938 - DNA, 201 bp, Homo sapiens; identical to SEQ ID NO: 11918

SEQ ID NO: 11939 - DNA, 201 bp, Homo sapiens; identical to SEQ ID NO: 11919

SEQ ID NO: 11940 - DNA, 201 bp, Homo sapiens; identical to SEQ ID NO: 11920

SEQ ID NO: 11941 - DNA, 201 bp, Homo sapiens; identical to SEQ ID NO: 11921

SEQ ID NO: 11942 - DNA, 201 bp, Homo sapiens; identical to SEQ ID NO: 11922

SEQ ID NO: 11943 - DNA, 201 bp, Homo sapiens
agattgttcaacatgagagaaaggctcagcaacgtgaaataacgcaaatggcttcctctttccttttttggaccatctcagtctttatttgtgtaattcaktttgaggaaaaaacaactccatgtatttattcaagtgcattaaagtctacaatggaaaaaaagcagtgaagccttcctttctttcctaccatgtaaccct

SEQ ID NO: 11944 - DNA, 201 bp, Homo sapiens; identical to SEQ ID NO: 11924

SEQ ID NO: 11945 - DNA, 201 bp, Homo sapiens; identical to SEQ ID NO: 11925

SEQ ID NO: 11946 - DNA, 195 bp, Homo sapiens
atgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctggtccaacagtcgtatcctggtgaatgtctgttcagctcttctgt

SEQ ID NO: 11947 - DNA, 201 bp, Homo sapiens; identical to SEQ ID NO: 11927

SEQ ID NO: 11948 - DNA, 201 bp, Homo sapiens; identical to SEQ ID NO: 11928

SEQ ID NO: 11949 - DNA, 201 bp, Homo sapiens; identical to SEQ ID NO: 11929

SEQ ID NO: 11950 - DNA, 201 bp, Homo sapiens; identical to SEQ ID NO: 11930

SEQ ID NO: 11951 - DNA, 201 bp, Homo sapiens; identical to SEQ ID NO: 11931

SEQ ID NO: 11952 - DNA, 201 bp, Homo sapiens; identical to SEQ ID NO: 11932

SEQ ID NO: 11953 - DNA, 145 bp, Homo sapiens
gaggtgtgtagaacagggtcccacaggtttggggacattgagatcacttgtcttgtggtggggaggctgctgaggggtagcaggtccatctccagcagctkgtccaacagtcgtatcctggtgaatgtctgttcagctcttctgt

SEQ ID NO: 11954 - DNA, 201 bp, Homo sapiens; identical to SEQ ID NO: 11934

SEQ ID NO: 11955 - DNA, 201 bp, Homo sapiens; identical to SEQ ID NO: 11935

SEQ ID NO: 11956 - DNA, 201 bp, Homo sapiens
gggctgggccctccctgccacactagcttcccagggctgcccccgacaggctggctctcagtggaggccagagatctggaatcggggtcagcggggctacrgtccttccaggggctctggggcagctcccagcctcttcccatgctggtggccaccgtgtcccttgctgcggctgcatcttccagtctctcctccgtcttc

SEQ ID NO: 11957 - DNA, 201 bp, Homo sapiens
ccgacaggctggctctcagtggaggccagagatctggaatcggggtcagcggggctacagtccttccaggggctctggggcagctcccagcctcttcccaygctggtggccaccgtgtcccttgctgcggctgcatcttccagtctctcctccgtcttcctgtggccgctctctttataagaaccctggtcattgaattta

SEQ ID NO: 11958 - DNA, 201 bp, Homo sapiens
tcaaggaggctgtcaagaacctcgagtggattgcaggtggcacctggacaccctcagccctcaagtttgcctacgaccgcctcatcaaggagagccggcgscagaagacacgtgtgtttgcggtggtcatcacggacgggcgccacgaccctcgggacgatgacctcaacttgcgggcgctgtgcgaccgcgacgtcacag

SEQ ID NO: 11959 - DNA, 201 bp, Homo sapiens
aggaggctgtcaagaacctcgagtggattgcaggtggcacctggacaccctcagccctcaagtttgcctacgaccgcctcatcaaggagagccggcgccaraagacacgtgtgtttgcggtggtcatcacggacgggcgccacgaccctcgggacgatgacctcaacttgcgggcgctgtgcgaccgcgacgtcacagtga

SEQ ID NO: 11960 - DNA, 201 bp, Homo sapiens
cgaggagaccaaggcggcaagggggaccctggccgcccaggacgcagagggcccccgggagaaatcggggccaagggaagcaaggggtatcaaggcaacartggagccccaggaagtcctggtgtgaaaggagccaagggcgggcctgggccccgcggacccaaaggcgagccggggcgcaggggagaccccggcaccaag

SEQ ID NO: 11961 - DNA, 201 bp, Homo sapiens
cggacatcctgctcttccacatgaagcagttcgtgccgcagttcatcagccagctgcagaacgagttctacctggaccaggtggcgctgagctggcgctayggcggcctgcacttctctgaccaggtggaggtgttcagcccaccgggcagcgaccgggcctccttcatcaagaacctgcagggcatcagctccttccgcc

SEQ ID NO: 11962 - DNA, 201 bp, Homo sapiens
tcaagtttgcctacgaccgcctcatcaaggagagccggcgccagaagacacgtgtgtttgcggtggtcatcacggacgggcgccacgaccctcgggacgaygacctcaacttgcgggcgctgtgcgaccgcgacgtcacagtgacggccatcggcatcggggacatgttccacgagaagcacgagagtgaaaacctctact

SEQ ID NO: 11963 - DNA, 201 bp, Homo sapiens
tcgccgtggcccccaaccagaacctgaaggagcagggcctgcgggacatcgccagcacgccgcacgagctctaccgcaacgactacgccaccatgctgccygactccaccgagatcgaccaggacaccatcaaccgcatcatcaaggtcatgaaacacgaagcctacggagagtgctacaaggtgagctgcctggaaatcc

SEQ ID NO: 11964 - DNA, 201 bp, Homo sapiens
gccatcgctaaggaccccaagtccgagacagggacgcgtgtgggcgtggtgcagtacagccacgagggcacctttgaggccatccagctggacgacgaacrtatcgactccctgtcgagcttcaaggaggctgtcaagaacctcgagtggattgcaggtggcacctggacaccctcagccctcaagtttgcctacgaccgc

SEQ ID NO: 11965 - DNA, 201 bp, Homo sapiens
aggagagccggcgccagaagacacgtgtgtttgcggtggtcatcacggacgggcgccacgaccctcgggacgatgacctcaacttgcgggcgctgtgcgaycgcgacgtcacagtgacggccatcggcatcggggacatgttccacgagaagcacgagagtgaaaacctctactccatcgcctgcgacaagccacagcagg

SEQ ID NO: 11966 - DNA, 201 bp, Homo sapiens
acagccacgagggcacctttgaggccatccagctggacgacgaacatatcgactccctgtcgagcttcaaggaggctgtcaagaacctcgagtggattgcrggtggcacctggacaccctcagccctcaagtttgcctacgaccgcctcatcaaggagagccggcgccagaagacacgtgtgtttgcggtggtcatcacgg

SEQ ID NO: 11967 - DNA, 201 bp, Homo sapiens
ccagaacctgaaggagcagggcctgcgggacatcgccagcacgccgcacgagctctaccgcaacgactacgccaccatgctgcccgactccaccgagatcraccaggacaccatcaaccgcatcatcaaggtcatgaaacacgaagcctacggagagtgctacaaggtgagctgcctggaaatccctgggccctctggccc

SEQ ID NO: 11968 - DNA, 201 bp, Homo sapiens
gccacgagggcacctttgaggccatccagctggacgacgaacatatcgactccctgtcgagcttcaaggaggctgtcaagaacctcgagtggattgcaggyggcacctggacaccctcagccctcaagtttgcctacgaccgcctcatcaaggagagccggcgccagaagacacgtgtgtttgcggtggtcatcacggacg

SEQ ID NO: 11969 - DNA, 201 bp, Homo sapiens
cgggcacccgcccagccgggctgggccctccctgccacactagcttcccagggctgcccccgacaggctggctctcagtggaggccagagatctggaatcsgggtcagcggggctacagtccttccaggggctctggggcagctcccagcctcttcccatgctggtggccaccgtgtcccttgctgcggctgcatcttcca

SEQ ID NO: 11970 - DNA, 201 bp, Homo sapiens
agtggattgcaggtggcacctggacaccctcagccctcaagtttgcctacgaccgcctcatcaaggagagccggcgccagaagacacgtgtgtttgcggtrgtcatcacggacgggcgccacgaccctcgggacgatgacctcaacttgcgggcgctgtgcgaccgcgacgtcacagtgacggccatcggcatcggggaca

SEQ ID NO: 11971 - DNA, 191 bp, Homo sapiens
tccttccaggggctctggggcagctcccagcctcttcccatgctggtggccaccgtgtcccttgctgcggctgcatcttccagtctctcctccgtcttccwgtggccgctctctttataagaaccctggtcattgaatttaaggcccaccccaagtccagaatgacctcgcaagacccttaactcactccc

SEQ ID NO: 11972 - DNA, 201 bp, Homo sapiens
gtcagcggggctacagtccttccaggggctctggggcagctcccagcctcttcccatgctggtggccaccgtgtcccttgctgcggctgcatcttccagtytctcctccgtcttcctgtggccgctctctttataagaaccctggtcattgaatttaaggcccaccccaagtccagaatgacctcgcaagacccttaactc

SEQ ID NO: 11973 - DNA, 201 bp, Homo sapiens
agagtgctacaaggtgagctgcctggaaatccctgggccctctggccccaagggctaccgtggacagaagggtgccaagggcaacatgggtgagccgggaragcctggccagaagggaagacagggagacccgggcatcgaaggccccattggattcccaggacccaagggcgttcctggcttcaaaggagagaagggtga

SEQ ID NO: 11974 - DNA, 201 bp, Homo sapiens
gctggagaggttggcaacaaaggagccaagggagaccgaggcttgcctggacccagaggcccccagggagctcttggggagcccggaaagcagggatctcrgggagaccccggtgatgcaggaccccgtggagactcaggacagccaggccccaagggagaccccggcaggcctggattcagctacccaggaccccgagga

SEQ ID NO: 11975 - DNA, 201 bp, Homo sapiens
cgggagaaatcggggccaagggaagcaaggggtatcaaggcaacaatggagccccaggaagtcctggtgtgaaaggagccaagggcgggcctgggccccgyggacccaaaggcgagccggggcgcaggggagaccccggcaccaagggcagcccaggcagcgatggccccaagggggagaagggggaccctggccctgagg

SEQ ID NO: 11976 - DNA, 201 bp, Homo sapiens; identical to SEQ ID NO: 11958

SEQ ID NO: 11977 - DNA, 201 bp, Homo sapiens; identical to SEQ ID NO: 11959

SEQ ID NO: 11978 - DNA, 201 bp, Homo sapiens; identical to SEQ ID NO: 11962

SEQ ID NO: 11979 - DNA, 201 bp, Homo sapiens; identical to SEQ ID NO: 11961

SEQ ID NO: 11980 - DNA, 201 bp, Homo sapiens
acccggcttcttcgaccgcttcatccgctggatctgctagcgccgccgcccgggccccgcagtcgagggtcgtgagcccaccccgtccatggtgctaagcrggcccgggtcccacacggccagcaccgctgctcactcggacgacgccctgggcctgcacctctccagctcctcccacggggtccccgtagccccggcccc

SEQ ID NO: 11981 - DNA, 201 bp, Homo sapiens; identical to SEQ ID NO: 11963

SEQ ID NO: 11982 - DNA, 201 bp, Homo sapiens; identical to SEQ ID NO: 11964

SEQ ID NO: 11983 - DNA, 201 bp, Homo sapiens; identical to SEQ ID NO: 11965

SEQ ID NO: 11984 - DNA, 201 bp, Homo sapiens; identical to SEQ ID NO: 11966

SEQ ID NO: 11985 - DNA, 201 bp, Homo sapiens; identical to SEQ ID NO: 11967

SEQ ID NO: 11986 - DNA, 201 bp, Homo sapiens; identical to SEQ ID NO: 11968

SEQ ID NO: 11987 - DNA, 201 bp, Homo sapiens; identical to SEQ ID NO: 11970

SEQ ID NO: 11988 - DNA, 201 bp, Homo sapiens; identical to SEQ ID NO: 11973

SEQ ID NO: 11989 - DNA, 201 bp, Homo sapiens; identical to SEQ ID NO: 11974

SEQ ID NO: 11990 - DNA, 201 bp, Homo sapiens
gcagtcgagggtcgtgagcccaccccgtccatggtgctaagcgggcccgggtcccacacggccagcaccgctgctcactcggacgacgccctgggcctgcrcctctccagctcctcccacggggtccccgtagccccggcccccgcccagccccaggtctccccaggccctccgcaggctgcccggcctccctccccctgc

SEQ ID NO: 11991 - DNA, 201 bp, Homo sapiens
tcgagggtcgtgagcccaccccgtccatggtgctaagcgggcccgggtcccacacggccagcaccgctgctcactcggacgacgccctgggcctgcacctytccagctcctcccacggggtccccgtagccccggcccccgcccagccccaggtctccccaggccctccgcaggctgcccggcctccctccccctgcagcc

SEQ ID NO: 11992 - DNA, 201 bp, Homo sapiens
ccgtggacatcgtcttcctgctggacggctccgagcggctgggtgagcagaacttccacaaggcccggcgcttcgtggagcaggtggcgcggcggctgacrctggcccggagggacgacgaccctctcaacgcacgcgtggcgctgctgcagtttggtggccccggcgagcagcaggtggccttcccgctgagccacaacc

SEQ ID NO: 11993 - DNA, 201 bp, Homo sapiens
cggcgcactccatgcgcaagcagaacgtggtacccaccgtgctggccttgggcagcgacgtggacatggacgtgctcaccacgctcagcctgggtgaccgygccgccgtgttccacgagaaggactatgacagcctggcgcaacccggcttcttcgaccgcttcatccgctggatctgctagcgccgccgcccgggccccg

SEQ ID NO: 11994 - DNA, 201 bp, Homo sapiens
atcgtcttcctgctggacggctccgagcggctgggtgagcagaacttccacaaggcccggcgcttcgtggagcaggtggcgcggcggctgacgctggcccrgagggacgacgaccctctcaacgcacgcgtggcgctgctgcagtttggtggccccggcgagcagcaggtggccttcccgctgagccacaacctcacggcc

SEQ ID NO: 11995 - DNA, 201 bp, Homo sapiens; identical to SEQ ID NO: 11960

SEQ ID NO: 11996 - DNA, 201 bp, Homo sapiens
cccggagggacgacgaccctctcaacgcacgcgtggcgctgctgcagtttggtggccccggcgagcagcaggtggccttcccgctgagccacaacctcackgccatccacgaggcgctggagaccacacaatacctgaactccttctcgcacgtgggcgcaggcgtggtgcacgccatcaatgccatcgtgcgcagcccgc

SEQ ID NO: 11997 - DNA, 201 bp, Homo sapiens
cacgcgtggcgctgctgcagtttggtggccccggcgagcagcaggtggccttcccgctgagccacaacctcacggccatccacgaggcgctggagaccacrcaatacctgaactccttctcgcacgtgggcgcaggcgtggtgcacgccatcaatgccatcgtgcgcagcccgcgtggcggggcccggaggcacgcagagc

SEQ ID NO: 11998 - DNA, 201 bp, Homo sapiens
ccacgaggcgctggagaccacacaatacctgaactccttctcgcacgtgggcgcaggcgtggtgcacgccatcaatgccatcgtgcgcagcccgcgtggcrgggcccggaggcacgcagagctgtccttcgtgttcctcacggacggcgtcacgggcaacgacagtctgcacgagtcggcgcactccatgcgcaagcagaa

SEQ ID NO: 11999 - DNA, 201 bp, Homo sapiens
tgctggccttgggcagcgacgtggacatggacgtgctcaccacgctcagcctgggtgaccgcgccgccgtgttccacgagaaggactatgacagcctggcrcaacccggcttcttcgaccgcttcatccgctggatctgctagcgccgccgcccgggccccgcagtcgagggtcgtgagcccaccccgtccatggtgctaa

SEQ ID NO: 12000 - DNA, 201 bp, Homo sapiens
cttgggcagcgacgtggacatggacgtgctcaccacgctcagcctgggtgaccgcgccgccgtgttccacgagaaggactatgacagcctggcgcaacccrgcttcttcgaccgcttcatccgctggatctgctagcgccgccgcccgggccccgcagtcgagggtcgtgagcccaccccgtccatggtgctaagcgggcc

SEQ ID NO: 12001 - DNA, 201 bp, Homo sapiens
tatgacagcctggcgcaacccggcttcttcgaccgcttcatccgctggatctgctagcgccgccgcccgggccccgcagtcgagggtcgtgagcccacccygtccatggtgctaagcgggcccgggtcccacacggccagcaccgctgctcactcggacgacgccctgggcctgcacctctccagctcctcccacggggtc

SEQ ID NO: 12002 - DNA, 201 bp, Homo sapiens
catggacgtgctcaccacgctcagcctgggtgaccgcgccgccgtgttccacgagaaggactatgacagcctggcgcaacccggcttcttcgaccgcttcmtccgctggatctgctagcgccgccgcccgggccccgcagtcgagggtcgtgagcccaccccgtccatggtgctaagcgggcccgggtcccacacggccag

SEQ ID NO: 12003 - DNA, 201 bp, Homo sapiens
gcttcttcgaccgcttcatccgctggatctgctagcgccgccgcccgggccccgcagtcgagggtcgtgagcccaccccgtccatggtgctaagcgggccsgggtcccacacggccagcaccgctgctcactcggacgacgccctgggcctgcacctctccagctcctcccacggggtccccgtagccccggcccccgccc

SEQ ID NO: 12004 - DNA, 201 bp, Homo sapiens
gcactccatgcgcaagcagaacgtggtacccaccgtgctggccttgggcagcgacgtggacatggacgtgctcaccacgctcagcctgggtgaccgcgccrccgtgttccacgagaaggactatgacagcctggcgcaacccggcttcttcgaccgcttcatccgctggatctgctagcgccgccgcccgggccccgcagt

SEQ ID NO: 12005 - DNA, 201 bp, Homo sapiens
gcgcaacccggcttcttcgaccgcttcatccgctggatctgctagcgccgccgcccgggccccgcagtcgagggtcgtgagcccaccccgtccatggtgckaagcgggcccgggtcccacacggccagcaccgctgctcactcggacgacgccctgggcctgcacctctccagctcctcccacggggtccccgtagccccg

SEQ ID NO: 12006 - DNA, 201 bp, Homo sapiens; identical to SEQ ID NO: 11975

SEQ ID NO: 12007 - DNA, 201 bp, Homo sapiens
cccgcagtcgagggtcgtgagcccaccccgtccatggtgctaagcgggcccgggtcccacacggccagcaccgctgctcactcggacgacgccctgggccygcacctctccagctcctcccacggggtccccgtagccccggcccccgcccagccccaggtctccccaggccctccgcaggctgcccggcctccctccccc

SEQ ID NO: 12008 - DNA, 201 bp, Homo sapiens; identical to SEQ ID NO: 11956

SEQ ID NO: 12009 - DNA, 201 bp, Homo sapiens; identical to SEQ ID NO: 11957

SEQ ID NO: 12010 - DNA, 201 bp, Homo sapiens; identical to SEQ ID NO: 11958

SEQ ID NO: 12011 - DNA, 201 bp, Homo sapiens; identical to SEQ ID NO: 11959

SEQ ID NO: 12012 - DNA, 201 bp, Homo sapiens; identical to SEQ ID NO: 11960

SEQ ID NO: 12013 - DNA, 201 bp, Homo sapiens; identical to SEQ ID NO: 11961

SEQ ID NO: 12014 - DNA, 201 bp, Homo sapiens; identical to SEQ ID NO: 11962

SEQ ID NO: 12015 - DNA, 201 bp, Homo sapiens; identical to SEQ ID NO: 11963

SEQ ID NO: 12016 - DNA, 201 bp, Homo sapiens; identical to SEQ ID NO: 11964

SEQ ID NO: 12017 - DNA, 201 bp, Homo sapiens; identical to SEQ ID NO: 11965

SEQ ID NO: 12018 - DNA, 201 bp, Homo sapiens; identical to SEQ ID NO: 11966

SEQ ID NO: 12019 - DNA, 201 bp, Homo sapiens; identical to SEQ ID NO: 11967

SEQ ID NO: 12020 - DNA, 201 bp, Homo sapiens; identical to SEQ ID NO: 11969

SEQ ID NO: 12021 - DNA, 201 bp, Homo sapiens; identical to SEQ ID NO: 11968

SEQ ID NO: 12022 - DNA, 201 bp, Homo sapiens; identical to SEQ ID NO: 11972

SEQ ID NO: 12023 - DNA, 191 bp, Homo sapiens; identical to SEQ ID NO: 11971

SEQ ID NO: 12024 - DNA, 201 bp, Homo sapiens; identical to SEQ ID NO: 11970

SEQ ID NO: 12025 - DNA, 201 bp, Homo sapiens; identical to SEQ ID NO: 11973

SEQ ID NO: 12026 - DNA, 201 bp, Homo sapiens
cgacctggtcgctgagaagttcatcgatgacatggaggacgtcctctgcccggaccctcagatcgtgtgcccagaccttccctgccaaacaggtttggacrgagctgttttgtgctgaaaggttttctcggggtccgtggtgtcccccaaaggtgccaccgtgcgggtctcctagctccctgccagcttcctgtccctgtg

SEQ ID NO: 12027 - DNA, 201 bp, Homo sapiens; identical to SEQ ID NO: 11974

SEQ ID NO: 12028 - DNA, 201 bp, Homo sapiens; identical to SEQ ID NO: 11975

SEQ ID NO: 12029 - DNA, 201 bp, Homo sapiens
gtcggggggacagctccactctgactggcacagtctttgcatggagacttgaggagggagggcttgaggttggtgaggttaggtgcgtgtttcctgtgcamgtcaggacatcagtctgattaaaggtggtgccaatttatttacatttaaacttgtcagggtataaaatgacatcccattaattatattgttaatcaatca

SEQ ID NO: 12030 - DNA, 201 bp, Homo sapiens
ccgagatcatccccaagtcagccgtgggggagctgtctgaggactccagcaatgtggtccatctcattaagaatgcttacaataaactctcctccagggtmttcctggatcacaacgccctccccgacaccctgaaagtcacctacgactccttctgcagcaatggagtgacgcacaggaaccagcccagaggtgactgtg

SEQ ID NO: 12031 - DNA, 201 bp, Homo sapiens
gtgtctgcgggcagtgcctgtgccacaccagcgacgtccccggcaagctgatatacgggcagtactgcgagtgtgacaccatcaactgtgagcgctacaayggccaggtctgcggcggcccggggagggggctctgcttctgcgggaagtgccgctgccacccgggctttgagggctcagcgtgccagtgcgagaggacca

SEQ ID NO: 12032 - DNA, 201 bp, Homo sapiens
cgatcaccttccaggtgaaggtcacggccacagagtgcatccaggagcagtcgtttgtcatccgggcgctgggcttcacggacatagtgaccgtgcaggtycttccccagtgtgagtgccggtgccgggaccagagcagagaccgcagcctctgccatggcaagggcttcttggagtgcggcatctgcaggtgtgacactg

SEQ ID NO: 12033 - DNA, 201 bp, Homo sapiens
atgcatcgagtcggggcccggctgcacctggtgccagaagctgaacttcacagggccgggggatcctgactccattcgctgcgacacccggccacagctgytcatgaggggctgtgcggctgacgacatcatggaccccacaagcctcgctgaaacccaggaagaccacaatgggggccagaagcagctgtccccacaaaa

SEQ ID NO: 12034 - DNA, 201 bp, Homo sapiens
tgcatcgagtcggggcccggctgcacctggtgccagaagctgaacttcacagggccgggggatcctgactccattcgctgcgacacccggccacagctgcycatgaggggctgtgcggctgacgacatcatggaccccacaagcctcgctgaaacccaggaagaccacaatgggggccagaagcagctgtccccacaaaaa

SEQ ID NO: 12035 - DNA, 201 bp, Homo sapiens
acaactccatcatctgctcagggctgggggactgtgtctgcgggcagtgcctgtgccacaccagcgacgtccccggcaagctgatatacgggcagtactgmgagtgtgacaccatcaactgtgagcgctacaacggccaggtctgcggcggcccggggagggggctctgcttctgcgggaagtgccgctgccacccgggct

SEQ ID NO: 12036 - DNA, 201 bp, Homo sapiens
tggacgccatgatgcaggtcgccgcctgcccggaggaaatcggctggcgcaacgtcacgcggctgctggtgtttgccactgatgacggcttccatttcgcrggcgacgggaagctgggcgccatcctgacccccaacgacggccgctgtcacctggaggacaacttgtacaagaggagcaacgaattcgactacccatcgg

SEQ ID NO: 12037 - DNA, 201 bp, Homo sapiens
actctcctccagggtcttcctggatcacaacgccctccccgacaccctgaaagtcacctacgactccttctgcagcaatggagtgacgcacaggaaccagyccagaggtgactgtgatggcgtgcagatcaatgtcccgatcaccttccaggtgaaggtcacggccacagagtgcatccaggagcagtcgtttgtcatccg

SEQ ID NO: 12038 - DNA, 185 bp, Homo sapiens
gagtggcatgctttgacagcaagtggactccgagtccagggcagagcctcagacatgctgggcctgcgccccccactgctcgccytggtggggctgctctccctcgggtgcgtcctctctcaggagtgcacgaagttcaaggtcagcagctgccgggaatgcatcgagtcggggcccggctgcac

SEQ ID NO: 12039 - DNA, 201 bp, Homo sapiens
ccagcaatgtggtccatctcattaagaatgcttacaataaactctcctccagggtcttcctggatcacaacgccctccccgacaccctgaaagtcacctaygactccttctgcagcaatggagtgacgcacaggaaccagcccagaggtgactgtgatggcgtgcagatcaatgtcccgatcaccttccaggtgaaggtca

SEQ ID NO: 12040 - DNA, 201 bp, Homo sapiens
gtgagtgccagacacagggccggagcagccaggagctggaaggaagctgccggaaggacaacaactccatcatctgctcagggctgggggactgtgtctgygggcagtgcctgtgccacaccagcgacgtccccggcaagctgatatacgggcagtactgcgagtgtgacaccatcaactgtgagcgctacaacggccagg

SEQ ID NO: 12041 - DNA, 201 bp, Homo sapiens
acccatcggtgggccagctggcgcacaagctggctgaaaacaacatccagcccatcttcgcggtgaccagtaggatggtgaagacctacgagaaactcacygagatcatccccaagtcagccgtgggggagctgtctgaggactccagcaatgtggtccatctcattaagaatgcttacaataaactctcctccagggtct

SEQ ID NO: 12042 - DNA, 201 bp, Homo sapiens
catcgccgccatcgtcgggggcaccgtggcaggcatcgtgctgatcggcattctcctgctggtcatctggaaggctctgatccacctgagcgacctccggkagtacaggcgctttgagaaggagaagctcaagtcccagtggaacaatgataatccccttttcaagagcgccaccacgacggtcatgaaccccaagtttgc

SEQ ID NO: 12043 - DNA, 201 bp, Homo sapiens
cggctggcgcaacgtcacgcggctgctggtgtttgccactgatgacggcttccatttcgcgggcgacgggaagctgggcgccatcctgacccccaacgacrgccgctgtcacctggaggacaacttgtacaagaggagcaacgaattcgactacccatcggtgggccagctggcgcacaagctggctgaaaacaacatcca

SEQ ID NO: 12044 - DNA, 201 bp, Homo sapiens
catggaccccacaagcctcgctgaaacccaggaagaccacaatgggggccagaagcagctgtccccacaaaaagtgacgctttacctgcgaccaggcttcrggtccttcgtggacaagaccgtgctgccgttcgtgaacacgcaccctgataagctgcgaaacccatgccccaacaaggagaaagagtgccagcccccgtt

SEQ ID NO: 12045 - DNA, 201 bp, Homo sapiens
tacctgcgaccaggcttcgggtccttcgtggacaagaccgtgctgccgttcgtgaacacgcaccctgataagctgcgaaacccatgccccaacaaggagamagagtgccagcccccgtttgccttcaggcacgtgctgaagctgaccaacaactccaaccagtttcagaccgaggtcgggaagcagctgatttccggaaac

SEQ ID NO: 12046 - DNA, 201 bp, Homo sapiens
catgatgcaggtcgccgcctgcccggaggaaatcggctggcgcaacgtcacgcggctgctggtgtttgccactgatgacggcttccatttcgcgggcgacrggaagctgggcgccatcctgacccccaacgacggccgctgtcacctggaggacaacttgtacaagaggagcaacgaattcgactacccatcggtgggcca

SEQ ID NO: 12047 - DNA, 178 bp, Homo sapiens
gagtggcatgctttgacagcaagtggactccgagtccagggcagagcctcagacatgctgggcctgcgccccccactkctcgccctggtggggctgctctccctcgggtgcgtcctctctcaggagtgcacgaagttcaaggtcagcagctgccgggaatgcatcgagtcggggcccg

SEQ ID NO: 12048 - DNA, 201 bp, Homo sapiens
ctgcttctgcgggaagtgccgctgccacccgggctttgagggctcagcgtgccagtgcgagaggaccactgagggctgcctgaacccgcggcgtgttgagygtagtggtcgtggccggtgccgctgcaacgtatgcgagtgccattcaggctaccagctgcctctgtgccaggagtgccccggctgcccctcaccctgtgg

SEQ ID NO: 12049 - DNA, 156 bp, Homo sapiens
gagtggcatgctttgacagcaagtggactccgagtccagggcagagcctcagacawgctgggcctgcgccccccactgctcgccctggtggggctgctctccctcgggtgcgtcctctctcaggagtgcacgaagttcaaggtcagcagctgccgg

SEQ ID NO: 12050 - DNA, 201 bp, Homo sapiens
agtgcggcatctgcaggtgtgacactggctacattgggaaaaactgtgagtgccagacacagggccggagcagccaggagctggaaggaagctgccggaargacaacaactccatcatctgctcagggctgggggactgtgtctgcgggcagtgcctgtgccacaccagcgacgtccccggcaagctgatatacgggcagt

SEQ ID NO: 12051 - DNA, 201 bp, Homo sapiens
gccacagctcttgaggatgtcaccaattaaccagaaatccagttattttccgccctcaaaatgacagccatggccggccgggtgcttctgggggctcgtcsgggggacagctccactctgactggcacagtctttgcatggagacttgaggagggagggcttgaggttggtgaggttaggtgcgtgtttcctgtgcaagtc

SEQ ID NO: 12052 - DNA, 201 bp, Homo sapiens
ccgtcaggacccaccatgtctgccccatcacgcggccgagacatggcttgccacagctcttgaggatgtcaccaattaaccagaaatccagttattttccrccctcaaaatgacagccatggccggccgggtgcttctgggggctcgtcggggggacagctccactctgactggcacagtctttgcatggagacttgagga

SEQ ID NO: 12053 - DNA, 201 bp, Homo sapiens
cgggaagtgccgctgccacccgggctttgagggctcagcgtgccagtgcgagaggaccactgagggctgcctgaacccgcggcgtgttgagtgtagtggtygtggccggtgccgctgcaacgtatgcgagtgccattcaggctaccagctgcctctgtgccaggagtgccccggctgcccctcaccctgtggcaagtacat

SEQ ID NO: 12054 - DNA, 201 bp, Homo sapiens
ggggagggggctctgcttctgcgggaagtgccgctgccacccgggctttgagggctcagcgtgccagtgcgagaggaccactgagggctgcctgaacccgyggcgtgttgagtgtagtggtcgtggccggtgccgctgcaacgtatgcgagtgccattcaggctaccagctgcctctgtgccaggagtgccccggctgccc

SEQ ID NO: 12055 - DNA, 201 bp, Homo sapiens
cggtgaccagtaggatggtgaagacctacgagaaactcaccgagatcatccccaagtcagccgtgggggagctgtctgaggactccagcaatgtggtccawctcattaagaatgcttacaataaactctcctccagggtcttcctggatcacaacgccctccccgacaccctgaaagtcacctacgactccttctgcagca

SEQ ID NO: 12056 - DNA, 167 bp, Homo sapiens
gagtggcatgctttgacagcaagtggactccgagtccagggcagagcctcagacatgctgggcctgygccccccactgctcgccctggtggggctgctctccctcgggtgcgtcctctctcaggagtgcacgaagttcaaggtcagcagctgccgggaatgcatcga

SEQ ID NO: 12057 - DNA, 201 bp, Homo sapiens
ccgggaatgcatcgagtcggggcccggctgcacctggtgccagaagctgaacttcacagggccgggggatcctgactccattcgctgcgacacccggccayagctgctcatgaggggctgtgcggctgacgacatcatggaccccacaagcctcgctgaaacccaggaagaccacaatgggggccagaagcagctgtcccc

SEQ ID NO: 12058 - DNA, 201 bp, Homo sapiens
tgatgcaggtcgccgcctgcccggaggaaatcggctggcgcaacgtcacgcggctgctggtgtttgccactgatgacggcttccatttcgcgggcgacggraagctgggcgccatcctgacccccaacgacggccgctgtcacctggaggacaacttgtacaagaggagcaacgaattcgactacccatcggtgggccagc

SEQ ID NO: 12059 - DNA, 201 bp, Homo sapiens
gaccgaggtcgggaagcagctgatttccggaaacctggatgcacccgagggtgggctggacgccatgatgcaggtcgccgcctgcccggaggaaatcggcyggcgcaacgtcacgcggctgctggtgtttgccactgatgacggcttccatttcgcgggcgacgggaagctgggcgccatcctgacccccaacgacggccg

SEQ ID NO: 12060 - DNA, 201 bp, Homo sapiens
gcaacgtatgcgagtgccattcaggctaccagctgcctctgtgccaggagtgccccggctgcccctcaccctgtggcaagtacatctcctgcgccgagtgyctgaagttcgaaaagggcccctttgggaagaactgcagcgcggcgtgtccgggcctgcagctgtcgaacaaccccgtgaagggcaggacctgcaaggaga

SEQ ID NO: 12061 - DNA, 201 bp, Homo sapiens
ctggacgccatgatgcaggtcgccgcctgcccggaggaaatcggctggcgcaacgtcacgcggctgctggtgtttgccactgatgacggcttccatttcgygggcgacgggaagctgggcgccatcctgacccccaacgacggccgctgtcacctggaggacaacttgtacaagaggagcaacgaattcgactacccatcg

SEQ ID NO: 12062 - DNA, 201 bp, Homo sapiens
cccatcacgcggccgagacatggcttgccacagctcttgaggatgtcaccaattaaccagaaatccagttattttccgccctcaaaatgacagccatggcmggccgggtgcttctgggggctcgtcggggggacagctccactctgactggcacagtctttgcatggagacttgaggagggagggcttgaggttggtgagg

SEQ ID NO: 12063 - DNA, 201 bp, Homo sapiens; identical to SEQ ID NO: 12029

SEQ ID NO: 12064 - DNA, 201 bp, Homo sapiens; identical to SEQ ID NO: 12030

SEQ ID NO: 12065 - DNA, 201 bp, Homo sapiens
ccagaagcagctgtccccacaaaaagtgacgctttacctgcgaccaggccaggcagcagcgttcaacgtgaccttccggcgggccaagggctaccccatcracctgtactatctgatggacctctcctactccatgcttgatgacctcaggaatgtcaagaagctaggtggcgacctgctccgggccctcaacgagatcac

SEQ ID NO: 12066 - DNA, 201 bp, Homo sapiens; identical to SEQ ID NO: 12031

SEQ ID NO: 12067 - DNA, 148 bp, Homo sapiens
gaggagctgagaggaacaggaagtgtcaggactttacgacccgcgccyccagctgaggtttctagacgtgacccagggcagactggtagcaaagcccccacgcccagccaggagcaccgccgaggactccagcacaccgagggacatg

SEQ ID NO: 12068 - DNA, 201 bp, Homo sapiens; identical to SEQ ID NO: 12032

SEQ ID NO: 12069 - DNA, 201 bp, Homo sapiens; identical to SEQ ID NO: 12033

SEQ ID NO: 12070 - DNA, 201 bp, Homo sapiens; identical to SEQ ID NO: 12034

SEQ ID NO: 12071 - DNA, 201 bp, Homo sapiens; identical to SEQ ID NO: 12035

SEQ ID NO: 12072 - DNA, 201 bp, Homo sapiens; identical to SEQ ID NO: 12036

SEQ ID NO: 12073 - DNA, 201 bp, Homo sapiens; identical to SEQ ID NO: 12037

SEQ ID NO: 12074 - DNA, 201 bp, Homo sapiens; identical to SEQ ID NO: 12039

SEQ ID NO: 12075 - DNA, 201 bp, Homo sapiens
gggcagactggtagcaaagcccccacgcccagccaggagcaccgccgaggactccagcacaccgagggacatgctgggcctgcgccccccactgctcgccytggtggggctgctctccctcgggtgcgtcctctctcaggagtgcacgaagttcaaggtcagcagctgccgggaatgcatcgagtcggggcccggctgcac

SEQ ID NO: 12076 - DNA, 201 bp, Homo sapiens; identical to SEQ ID NO: 12041

SEQ ID NO: 12077 - DNA, 201 bp, Homo sapiens; identical to SEQ ID NO: 12040

SEQ ID NO: 12078 - DNA, 201 bp, Homo sapiens; identical to SEQ ID NO: 12042

SEQ ID NO: 12079 - DNA, 201 bp, Homo sapiens; identical to SEQ ID NO: 12043

SEQ ID NO: 12080 - DNA, 201 bp, Homo sapiens
gctttacctgcgaccaggccaggcagcagcgttcaacgtgaccttccggcgggccaagggctaccccatcgacctgtactatctgatggacctctcctacyccatgcttgatgacctcaggaatgtcaagaagctaggtggcgacctgctccgggccctcaacgagatcaccgagtccggccgcattggcttcgggtcctt

SEQ ID NO: 12081 - DNA, 201 bp, Homo sapiens
aacgtgaccttccggcgggccaagggctaccccatcgacctgtactatctgatggacctctcctactccatgcttgatgacctcaggaatgtcaagaagcyaggtggcgacctgctccgggccctcaacgagatcaccgagtccggccgcattggcttcgggtccttcgtggacaagaccgtgctgccgttcgtgaacacg

SEQ ID NO: 12082 - DNA, 201 bp, Homo sapiens
ctcctactccatgcttgatgacctcaggaatgtcaagaagctaggtggcgacctgctccgggccctcaacgagatcaccgagtccggccgcattggcttcrggtccttcgtggacaagaccgtgctgccgttcgtgaacacgcaccctgataagctgcgaaacccatgccccaacaaggagaaagagtgccagcccccgtt

SEQ ID NO: 12083 - DNA, 201 bp, Homo sapiens
tccggccgcattggcttcgggtccttcgtggacaagaccgtgctgccgttcgtgaacacgcaccctgataagctgcgaaacccatgccccaacaaggagamagagtgccagcccccgtttgccttcaggcacgtgctgaagctgaccaacaactccaaccagtttcagaccgaggtcgggaagcagctgatttccggaaac

SEQ ID NO: 12084 - DNA, 201 bp, Homo sapiens; identical to SEQ ID NO: 12046

SEQ ID NO: 12085 - DNA, 201 bp, Homo sapiens
tgacccagggcagactggtagcaaagcccccacgcccagccaggagcaccgccgaggactccagcacaccgagggacatgctgggcctgcgccccccactkctcgccctggtggggctgctctccctcgggtgcgtcctctctcaggagtgcacgaagttcaaggtcagcagctgccgggaatgcatcgagtcggggcccg

SEQ ID NO: 12086 - DNA, 201 bp, Homo sapiens; identical to SEQ ID NO: 12048

SEQ ID NO: 12087 - DNA, 201 bp, Homo sapiens
ctccagctgaggtttctagacgtgacccagggcagactggtagcaaagcccccacgcccagccaggagcaccgccgaggactccagcacaccgagggacawgctgggcctgcgccccccactgctcgccctggtggggctgctctccctcgggtgcgtcctctctcaggagtgcacgaagttcaaggtcagcagctgccgg

SEQ ID NO: 12088 - DNA, 201 bp, Homo sapiens; identical to SEQ ID NO: 12050

SEQ ID NO: 12089 - DNA, 201 bp, Homo sapiens; identical to SEQ ID NO: 12051

SEQ ID NO: 12090 - DNA, 201 bp, Homo sapiens; identical to SEQ ID NO: 12052

SEQ ID NO: 12091 - DNA, 201 bp, Homo sapiens; identical to SEQ ID NO: 12053

SEQ ID NO: 12092 - DNA, 135 bp, Homo sapiens
gaggagctgagaggaacaggaagtgtcaggacttyacgacccgcgcctccagctgaggtttctagacgtgacccagggcagactggtagcaaagcccccacgcccagccaggagcaccgccgaggactccagcac

SEQ ID NO: 12093 - DNA, 201 bp, Homo sapiens; identical to SEQ ID NO: 12054

SEQ ID NO: 12094 - DNA, 201 bp, Homo sapiens
gtttctagacgtgacccagggcagactggtagcaaagcccccacgcccagccaggagcaccgccgaggactccagcacaccgagggacatgctgggcctgygccccccactgctcgccctggtggggctgctctccctcgggtgcgtcctctctcaggagtgcacgaagttcaaggtcagcagctgccgggaatgcatcga

SEQ ID NO: 12095 - DNA, 201 bp, Homo sapiens; identical to SEQ ID NO: 12055

SEQ ID NO: 12096 - DNA, 201 bp, Homo sapiens; identical to SEQ ID NO: 12057

SEQ ID NO: 12097 - DNA, 201 bp, Homo sapiens; identical to SEQ ID NO: 12059

SEQ ID NO: 12098 - DNA, 201 bp, Homo sapiens; identical to SEQ ID NO: 12058

SEQ ID NO: 12099 - DNA, 201 bp, Homo sapiens; identical to SEQ ID NO: 12061

SEQ ID NO: 12100 - DNA, 201 bp, Homo sapiens; identical to SEQ ID NO: 12060

SEQ ID NO: 12101 - DNA, 201 bp, Homo sapiens; identical to SEQ ID NO: 12062

SEQ ID NO: 12102 - DNA, 201 bp, Homo sapiens; identical to SEQ ID NO: 12029

SEQ ID NO: 12103 - DNA, 201 bp, Homo sapiens; identical to SEQ ID NO: 12030

SEQ ID NO: 12104 - DNA, 201 bp, Homo sapiens; identical to SEQ ID NO: 12065

SEQ ID NO: 12105 - DNA, 201 bp, Homo sapiens; identical to SEQ ID NO: 12031

SEQ ID NO: 12106 - DNA, 201 bp, Homo sapiens; identical to SEQ ID NO: 12032

SEQ ID NO: 12107 - DNA, 201 bp, Homo sapiens; identical to SEQ ID NO: 12033

SEQ ID NO: 12108 - DNA, 201 bp, Homo sapiens; identical to SEQ ID NO: 12034

SEQ ID NO: 12109 - DNA, 201 bp, Homo sapiens; identical to SEQ ID NO: 12035

SEQ ID NO: 12110 - DNA, 201 bp, Homo sapiens; identical to SEQ ID NO: 12036

SEQ ID NO: 12111 - DNA, 201 bp, Homo sapiens; identical to SEQ ID NO: 12037

SEQ ID NO: 12112 - DNA, 201 bp, Homo sapiens; identical to SEQ ID NO: 12039

SEQ ID NO: 12113 - DNA, 185 bp, Homo sapiens; identical to SEQ ID NO: 12038

SEQ ID NO: 12114 - DNA, 201 bp, Homo sapiens; identical to SEQ ID NO: 12041

SEQ ID NO: 12115 - DNA, 201 bp, Homo sapiens; identical to SEQ ID NO: 12040

SEQ ID NO: 12116 - DNA, 201 bp, Homo sapiens; identical to SEQ ID NO: 12042

SEQ ID NO: 12117 - DNA, 201 bp, Homo sapiens; identical to SEQ ID NO: 12043

SEQ ID NO: 12118 - DNA, 201 bp, Homo sapiens; identical to SEQ ID NO: 12080

SEQ ID NO: 12119 - DNA, 201 bp, Homo sapiens; identical to SEQ ID NO: 12081

SEQ ID NO: 12120 - DNA, 201 bp, Homo sapiens; identical to SEQ ID NO: 12082

SEQ ID NO: 12121 - DNA, 201 bp, Homo sapiens; identical to SEQ ID NO: 12083

SEQ ID NO: 12122 - DNA, 201 bp, Homo sapiens; identical to SEQ ID NO: 12046

SEQ ID NO: 12123 - DNA, 178 bp, Homo sapiens; identical to SEQ ID NO: 12047

SEQ ID NO: 12124 - DNA, 201 bp, Homo sapiens; identical to SEQ ID NO: 12048

SEQ ID NO: 12125 - DNA, 156 bp, Homo sapiens; identical to SEQ ID NO: 12049

SEQ ID NO: 12126 - DNA, 201 bp, Homo sapiens; identical to SEQ ID NO: 12050

SEQ ID NO: 12127 - DNA, 201 bp, Homo sapiens; identical to SEQ ID NO: 12051

SEQ ID NO: 12128 - DNA, 201 bp, Homo sapiens; identical to SEQ ID NO: 12052

SEQ ID NO: 12129 - DNA, 201 bp, Homo sapiens; identical to SEQ ID NO: 12053

SEQ ID NO: 12130 - DNA, 201 bp, Homo sapiens; identical to SEQ ID NO: 12054

SEQ ID NO: 12131 - DNA, 201 bp, Homo sapiens; identical to SEQ ID NO: 12055

SEQ ID NO: 12132 - DNA, 167 bp, Homo sapiens; identical to SEQ ID NO: 12056

SEQ ID NO: 12133 - DNA, 201 bp, Homo sapiens; identical to SEQ ID NO: 12057

SEQ ID NO: 12134 - DNA, 201 bp, Homo sapiens; identical to SEQ ID NO: 12058

SEQ ID NO: 12135 - DNA, 201 bp, Homo sapiens; identical to SEQ ID NO: 12059

SEQ ID NO: 12136 - DNA, 201 bp, Homo sapiens; identical to SEQ ID NO: 12060

SEQ ID NO: 12137 - DNA, 201 bp, Homo sapiens; identical to SEQ ID NO: 12061

SEQ ID NO: 12138 - DNA, 201 bp, Homo sapiens; identical to SEQ ID NO: 12062

SEQ ID NO: 12139 - DNA, 201 bp, Homo sapiens
aaagttgccattgcccggcgtatgccacctccagccaaccttccaagcctgaaagccgagaacaaaggcaatgaccccaatgtctcactagtgccaaaagwcggaacaggatgggcaagcaaacaggagcagtccgaccccaagagttccgatgcctcaaccgctcagccgccggaatcgcagccactgccggcttcacag

SEQ ID NO: 12140 - DNA, 201 bp, Homo sapiens
gaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggta

SEQ ID NO: 12141 - DNA, 201 bp, Homo sapiens
tgtccgatcgctcggggccgactgccaagggaaaggatggaaagaagtattcctcgctcaacctgtttgatacgtataagggcaagtccttagagatccaraaacccgctgttgcccctcgccatggcctgcagagtctcgggaaagttgccattgcccggcgtatgccacctccagccaaccttccaagcctgaaagccg

SEQ ID NO: 12142 - DNA, 201 bp, Homo sapiens
agaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactc

SEQ ID NO: 12143 - DNA, 201 bp, Homo sapiens
ccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcc

SEQ ID NO: 12144 - DNA, 201 bp, Homo sapiens
gtgctgagaagctcaagcgactcgatgaaaagtttggggcacctgacaagcggctcaaagcagagcctgctgccccacctgctgccccttctaccccagcyccaccacctgcagtccctaaagaactccctgcacctccagctccacctccagcatcagcctcccaaagtgctgggattacaggcgtgagccactgcacct

SEQ ID NO: 12145 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaa

SEQ ID NO: 12146 - DNA, 201 bp, Homo sapiens
aggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccct

SEQ ID NO: 12147 - DNA, 201 bp, Homo sapiens
gatacgtataagggcaagtccttagagatccagaaacccgctgttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 12148 - DNA, 201 bp, Homo sapiens
ctgttccttgtgagggtccacctggctctgaacctcctaggagaccaccacctgccccccacgatggggacagaaaggagctgccccgggagcagcctctrccccctggccccattggcacagaacgatcacagcgtacagaccgaggcacagagcctggccccattcggccatcccatcgacctggtcccccagtccagt

SEQ ID NO: 12149 - DNA, 201 bp, Homo sapiens
ggcccccacctgctcctgctactcgggtgctgccttcacctgccaggcccttccccgctagcttggggcgagcagagctgcatccagtggaactaaagccrttccaggattatcaaaaactgagcagcaaccttgggggacctggatcatcacggactcccccaactggaaggtccttctctggcctcaattcccgtctca

SEQ ID NO: 12150 - DNA, 201 bp, Homo sapiens
ccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctc

SEQ ID NO: 12151 - DNA, 201 bp, Homo sapiens
gcagcaggataaaccgcctcgtttccggaggctgaagcaggaacgggagaatgccgcaagggggtctgagggcaagccctccctaacccttccagcctccrctcctggacctgaggaggccctcacaacagtcacagtggccccagcacctcgccgggcagctgccaagtctcctgatctgtcaaaccagaactcagacca

SEQ ID NO: 12152 - DNA, 201 bp, Homo sapiens; identical to SEQ ID NO: 12146

SEQ ID NO: 12153 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaagtcgtcctccagaggagcgtcccccggg

SEQ ID NO: 12154 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagt

SEQ ID NO: 12155 - DNA, 201 bp, Homo sapiens
atctggctccttcagacaaggaggctcccacacccaaggagggaacactcacccaggtccctctcgctcccccaccaccaggagccccaccttcaccagcsccagcccgcttcactgcccggggtgggcgagtcttcactcccagaggggtgccatctcgccggggccgaggaggagggaggccccctcctcaagtttgcc

SEQ ID NO: 12156 - DNA, 201 bp, Homo sapiens
acaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggca

SEQ ID NO: 12157 - DNA, 201 bp, Homo sapiens
gccggcccccacccatgcccccaatgaactttgatccccgatggatgatgattcctccttatgtggacccccggctcctccagggtcgtccccctctagasttctaccctcctggtgtgcatccctctggcctagttccccgagagcgttcagacagtgggggctcaagctcagagccatttgaccgtcatgcacctgcta

SEQ ID NO: 12158 - DNA, 201 bp, Homo sapiens
ccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgcc

SEQ ID NO: 12159 - DNA, 201 bp, Homo sapiens
aggctgcggatgaggatgacaaggggatgaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 12160 - DNA, 201 bp, Homo sapiens; identical to SEQ ID NO: 12142

SEQ ID NO: 12161 - DNA, 201 bp, Homo sapiens
gataaaccgcctcgtttccggaggctgaagcaggaacgggagaatgccgcaagggggtctgagggcaagccctccctaacccttccagcctccgctcctgsacctgaggaggccctcacaacagtcacagtggccccagcacctcgccgggcagctgccaagtctcctgatctgtcaaaccagaactcagaccaagccaat

SEQ ID NO: 12162 - DNA, 201 bp, Homo sapiens
ggctgcggatgaggatgacaaggggatgaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 12163 - DNA, 201 bp, Homo sapiens; identical to SEQ ID NO: 12143

SEQ ID NO: 12164 - DNA, 201 bp, Homo sapiens
cggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctaccccccggcccagcccctccctcag

SEQ ID NO: 12165 - DNA, 201 bp, Homo sapiens
ggggagccatggactctcaattacatccaaacagtggaggcttccgccctgggacaccctcactgcacccttacagatcacagcccctatacctacccccsggcccagcccctccctcagcactgctctctggggtagctctcaagggccagtttctggatttctccacaatgcaagctacagagctggggaagttgccgg

SEQ ID NO: 12166 - DNA, 201 bp, Homo sapiens
cctaggagaccaccacctgccccccacgatggggacagaaaggagctgccccgggagcagcctctgccccctggccccattggcacagaacgatcacagcrtacagaccgaggcacagagcctggccccattcggccatcccatcgacctggtcccccagtccagtttggcactagtgacaaggactcagacttacgccta

SEQ ID NO: 12167 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggca

SEQ ID NO: 12168 - DNA, 201 bp, Homo sapiens
tacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 12169 - DNA, 191 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 12170 - DNA, 201 bp, Homo sapiens
ccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagt

SEQ ID NO: 12171 - DNA, 201 bp, Homo sapiens; identical to SEQ ID NO: 12139

SEQ ID NO: 12172 - DNA, 201 bp, Homo sapiens
gcagcaccagtggcagcagcatcaacagggctctgcccctcctaccccagtgcccccatcaccaccacagcctgtgaccctgggggctgtgccagctccamaggctccacccccgccccccaaggccctgtacccaggtgctctgggccggcccccacccatgcccccaatgaactttgatccccgatggatgatgattcc

SEQ ID NO: 12173 - DNA, 201 bp, Homo sapiens
atgaaagagtgggtcctacctcttgccggggtcggggccgaggcgagtattttgccagagggaggggttttcgggggacctatgggggacgagggcggggrgcccgaagccgggaattccgcagttaccgagagtttcgaggagatgatgggcgtggaggtgggacagggggaccaaaccaccctcctgctccccgaggcc

SEQ ID NO: 12174 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaaggtccttctctggcctcaattcccgtctcaaggccacgccttccacctacagtggagtcttccgcacccagcgcgtcgacct

SEQ ID NO: 12175 - DNA, 201 bp, Homo sapiens
ccatggtagactcacagctgcctgtggtgaactttggctccctgccgccagcaccacctcctgccccacctcccctttctctgttacctgtgggccctgcyctgcagccccccagcctggctgtgcggcccccacctgctcctgctactcgggtgctgccttcacctgccaggcccttccccgctagcttggggcgagcag

SEQ ID NO: 12176 - DNA, 201 bp, Homo sapiens
cgttccaggattatcaaaaactgagcagcaaccttgggggacctggatcatcacggactcccccaactggaaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 12177 - DNA, 190 bp, Homo sapiens
cccccaccccgctgagggagttcctcttgccccctacccccggggcttgtatatagattataaatatataagggggaaaggggtgggcggggaggggttgyggggctggggcctcacttcccctcctcccccttcccctggtcccctgtccctggggctgtttgttaaaaaagagtaataaaaggattta

SEQ ID NO: 12178 - DNA, 201 bp, Homo sapiens
aaacggagcttctcaagtcagcggccaggcatggaacggcagaatcggcgccctggcccagggggcaaggctggcagcagtggcagcagcagtggaggagscggtgggggtcctggaggaaggaccgggccaggacgaggcgacaagaggagctggccctctcccaagaaccgaagtcgtcctccagaggagcgtcccccg

SEQ ID NO: 12179 - DNA, 201 bp, Homo sapiens
aggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 12180 - DNA, 201 bp, Homo sapiens
gtgctgagaagctcaagcgactcgatgaaaagtttggggcacctgacaagcggctcaaagcagagcctgctgccccacctgctgccccttctaccccagcyccaccacctgcagtccctaaagaactccctgcacctccagctccacctccagcatcagccccaacaccagagaaagaacctgaagagccagcacaggccc

SEQ ID NO: 12181 - DNA, 201 bp, Homo sapiens
ttatgtggacccccggctcctccagggtcgtccccctctagacttctaccctcctggtgtgcatccctctggcctagttccccgagagcgttcagacagtsggggctcaagctcagagccatttgaccgtcatgcacctgctatgttacgggaacggggcactccaccggtggatccaaagttggcctgggtaggagatgt

SEQ ID NO: 12182 - DNA, 201 bp, Homo sapiens
caggctgcggatgaggatgacaaggggatgaggagcgagactcctccagtacctcccccaccaccctatctggccagttatccaggctttcctgagaatgragcccctgggcccccaatctctcgctttcctctggaggaaccagggccccgtccactcccctggcccccaggcagtgatgaagtggccaagatacaaact

SEQ ID NO: 12183 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactc

SEQ ID NO: 12184 - DNA, 201 bp, Homo sapiens
gcggagtcgggagtggaggccagggccccccaccaccacgcagagagagtcgcacagagacccgctggggccctcgtccagggagcagtcgtcgtggaatscctccagaggagccaggggccccaccccgccgggctgggcctataaagaaacctccaccacctacaaaagtagaagagctgcctcccaagcccctcgaac

SEQ ID NO: 12185 - DNA, 201 bp, Homo sapiens
gaaagagtgggtcctacctcttgccggggtcggggccgaggcgagtattttgccagagggaggggttttcgggggacctatgggggacgagggcggggagsccgaagccgggaattccgcagttaccgagagtttcgaggagatgatgggcgtggaggtgggacagggggaccaaaccaccctcctgctccccgaggccgc

SEQ ID NO: 12186 - DNA, 201 bp, Homo sapiens
aggtgggacagggggaccaaaccaccctcctgctccccgaggccgcactgccagcgagacacggagcgagggttcagagtatgaggaaatccccaagcggygccggcagcggggctcagaaacaggcagcgagacccatgagagtgatctggctccttcagacaaggaggctcccacacccaaggagggaacactcaccca

SEQ ID NO: 12187 - DNA, 201 bp, Homo sapiens
tcccacacccaaggagggaacactcacccaggtccctctcgctcccccaccaccaggagccccaccttcaccagccccagcccgcttcactgcccggggtsggcgagtcttcactcccagaggggtgccatctcgccggggccgaggaggagggaggccccctcctcaagtttgcccaggctggagccctccagccaagtc

SEQ ID NO: 12188 - DNA, 201 bp, Homo sapiens
tctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcggcctcccagaaaaccagagctgctacaggaggaatctttgcca

SEQ ID NO: 12189 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccg

SEQ ID NO: 12190 - DNA, 201 bp, Homo sapiens; identical to SEQ ID NO: 12147

SEQ ID NO: 12191 - DNA, 201 bp, Homo sapiens
attggcacagaacgatcacagcgtacagaccgaggcacagagcctggccccattcggccatcccatcgacctggtcccccagtccagtttggcactagtgrcaaggactcagacttacgcctagtggtaggagacagcttgaaagcagagaaggagctaacagcatcagtcactgaggccattcctgtatcacgagactgg

SEQ ID NO: 12192 - DNA, 201 bp, Homo sapiens
tacagaccgaggcacagagcctggccccattcggccatcccatcgacctggtcccccagtccagtttggcactagtgacaaggactcagacttacgcctartggtaggagacagcttgaaagcagagaaggagctaacagcatcagtcactgaggccattcctgtatcacgagactgggagctgcttcccagtgctgctgc

SEQ ID NO: 12193 - DNA, 201 bp, Homo sapiens; identical to SEQ ID NO: 12140

SEQ ID NO: 12194 - DNA, 201 bp, Homo sapiens; identical to SEQ ID NO: 12141

SEQ ID NO: 12195 - DNA, 201 bp, Homo sapiens
ccccagtccagtttggcactagtgacaaggactcagacttacgcctagtggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagc

SEQ ID NO: 12196 - DNA, 201 bp, Homo sapiens
tggaggcttccgccctgggacaccctcactgcacccttacagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 12197 - DNA, 201 bp, Homo sapiens
ctgcatccagtggaactaaagccgttccaggattatcaaaaactgagcagcaaccttgggggacctggatcatcacggactcccccaactggaaggtcctyctctggcctcaattcccgtctcaaggccacgccttccacctacagtggagtcttccgcacccagcgcgtcgacctttaccagcaggcctccccaccagat

SEQ ID NO: 12198 - DNA, 201 bp, Homo sapiens
gggagccatggactctcaattacatccaaacagtggaggcttccgccctgggacaccctcactgcacccttacagatcacagcccctatacctaccccccrgcccagcccctccctcagcactgctctctggggtagctctcaagggccagtttctggatttctccacaatgcaagctacagagctggggaagttgccggc

SEQ ID NO: 12199 - DNA, 201 bp, Homo sapiens
ccacctgccccccacgatggggacagaaaggagctgccccgggagcagcctctgccccctggccccattggcacagaacgatcacagcgtacagaccgagscacagagcctggccccattcggccatcccatcgacctggtcccccagtccagtttggcactagtgacaaggactcagacttacgcctagtggtaggagac

SEQ ID NO: 12200 - DNA, 201 bp, Homo sapiens; identical to SEQ ID NO: 12148

SEQ ID NO: 12201 - DNA, 201 bp, Homo sapiens
ggcccccacctgctcctgctactcgggtgctgccttcacctgccaggcccttccccgctagcttggggcgagcagagctgcatccagtggaactaaagccrttccaggattatcaaaaactgagcagcaaccttgggggacctggatcatcacggactcccccaactggaagacgcccttcttcccttaggtccttctctg

SEQ ID NO: 12202 - DNA, 201 bp, Homo sapiens; identical to SEQ ID NO: 12150

SEQ ID NO: 12203 - DNA, 201 bp, Homo sapiens; identical to SEQ ID NO: 12146

SEQ ID NO: 12204 - DNA, 201 bp, Homo sapiens; identical to SEQ ID NO: 12151

SEQ ID NO: 12205 - DNA, 201 bp, Homo sapiens; identical to SEQ ID NO: 12153

SEQ ID NO: 12206 - DNA, 201 bp, Homo sapiens; identical to SEQ ID NO: 12154

SEQ ID NO: 12207 - DNA, 201 bp, Homo sapiens; identical to SEQ ID NO: 12155

SEQ ID NO: 12208 - DNA, 201 bp, Homo sapiens; identical to SEQ ID NO: 12156

SEQ ID NO: 12209 - DNA, 201 bp, Homo sapiens; identical to SEQ ID NO: 12157

SEQ ID NO: 12210 - DNA, 201 bp, Homo sapiens; identical to SEQ ID NO: 12158

SEQ ID NO: 12211 - DNA, 201 bp, Homo sapiens; identical to SEQ ID NO: 12159

SEQ ID NO: 12212 - DNA, 201 bp, Homo sapiens; identical to SEQ ID NO: 12142

SEQ ID NO: 12213 - DNA, 201 bp, Homo sapiens; identical to SEQ ID NO: 12161

SEQ ID NO: 12214 - DNA, 201 bp, Homo sapiens; identical to SEQ ID NO: 12143

SEQ ID NO: 12215 - DNA, 201 bp, Homo sapiens; identical to SEQ ID NO: 12162

SEQ ID NO: 12216 - DNA, 201 bp, Homo sapiens; identical to SEQ ID NO: 12164

SEQ ID NO: 12217 - DNA, 201 bp, Homo sapiens; identical to SEQ ID NO: 12165

SEQ ID NO: 12218 - DNA, 201 bp, Homo sapiens; identical to SEQ ID NO: 12166

SEQ ID NO: 12219 - DNA, 201 bp, Homo sapiens; identical to SEQ ID NO: 12167

SEQ ID NO: 12220 - DNA, 201 bp, Homo sapiens; identical to SEQ ID NO: 12168

SEQ ID NO: 12221 - DNA, 190 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattt

SEQ ID NO: 12222 - DNA, 201 bp, Homo sapiens; identical to SEQ ID NO: 12170

SEQ ID NO: 12223 - DNA, 201 bp, Homo sapiens; identical to SEQ ID NO: 12139

SEQ ID NO: 12224 - DNA, 201 bp, Homo sapiens; identical to SEQ ID NO: 12172

SEQ ID NO: 12225 - DNA, 201 bp, Homo sapiens; identical to SEQ ID NO: 12173

SEQ ID NO: 12226 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaagacgcccttcttcccttaggtccttctctggcctcaattcccgtctcaaggccacgccttccacctacagtggagtcttccg

SEQ ID NO: 12227 - DNA, 201 bp, Homo sapiens; identical to SEQ ID NO: 12175

SEQ ID NO: 12228 - DNA, 201 bp, Homo sapiens
aactgagcagcaaccttgggggacctggatcatcacggactcccccaactggaagacgcccttcttcccttaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 12229 - DNA, 189 bp, Homo sapiens
cccccaccccgctgagggagttcctcttgccccctacccccggggcttgtatatagattataaatatataagggggaaaggggtgggcggggaggggttgyggggctggggcctcacttcccctcctcccccttcccctggtcccctgtccctggggctgtttgttaaaaaagagtaataaaaggattt

SEQ ID NO: 12230 - DNA, 201 bp, Homo sapiens; identical to SEQ ID NO: 12178

SEQ ID NO: 12231 - DNA, 201 bp, Homo sapiens; identical to SEQ ID NO: 12179

SEQ ID NO: 12232 - DNA, 201 bp, Homo sapiens; identical to SEQ ID NO: 12180

SEQ ID NO: 12233 - DNA, 201 bp, Homo sapiens; identical to SEQ ID NO: 12145

SEQ ID NO: 12234 - DNA, 201 bp, Homo sapiens; identical to SEQ ID NO: 12181

SEQ ID NO: 12235 - DNA, 201 bp, Homo sapiens; identical to SEQ ID NO: 12182

SEQ ID NO: 12236 - DNA, 201 bp, Homo sapiens; identical to SEQ ID NO: 12183

SEQ ID NO: 12237 - DNA, 201 bp, Homo sapiens; identical to SEQ ID NO: 12184

SEQ ID NO: 12238 - DNA, 201 bp, Homo sapiens; identical to SEQ ID NO: 12185

SEQ ID NO: 12239 - DNA, 201 bp, Homo sapiens; identical to SEQ ID NO: 12186

SEQ ID NO: 12240 - DNA, 201 bp, Homo sapiens; identical to SEQ ID NO: 12187

SEQ ID NO: 12241 - DNA, 201 bp, Homo sapiens; identical to SEQ ID NO: 12188

SEQ ID NO: 12242 - DNA, 201 bp, Homo sapiens; identical to SEQ ID NO: 12189

SEQ ID NO: 12243 - DNA, 201 bp, Homo sapiens
aacccgctggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 12244 - DNA, 201 bp, Homo sapiens; identical to SEQ ID NO: 12191

SEQ ID NO: 12245 - DNA, 201 bp, Homo sapiens; identical to SEQ ID NO: 12192

SEQ ID NO: 12246 - DNA, 201 bp, Homo sapiens; identical to SEQ ID NO: 12140

SEQ ID NO: 12247 - DNA, 201 bp, Homo sapiens
tgtccgatcgctcggggccgactgccaagggaaaggatggaaagaagtattcctcgctcaacctgtttgatacgtataagggcaagtccttagagatccaraaacccgctggcattttcgaccctctctccgtcttgttctccagttgcccctcgccatggcctgcagagtctcgggaaagttgccattgcccggcgtatg

SEQ ID NO: 12248 - DNA, 201 bp, Homo sapiens; identical to SEQ ID NO: 12195

SEQ ID NO: 12249 - DNA, 201 bp, Homo sapiens; identical to SEQ ID NO: 12196

SEQ ID NO: 12250 - DNA, 201 bp, Homo sapiens
aagccgttccaggattatcaaaaactgagcagcaaccttgggggacctggatcatcacggactcccccaactggaagacgcccttcttcccttaggtcctyctctggcctcaattcccgtctcaaggccacgccttccacctacagtggagtcttccgcacccagcgcgtcgacctttaccagcaggcctccccaccagat

SEQ ID NO: 12251 - DNA, 201 bp, Homo sapiens; identical to SEQ ID NO: 12198

SEQ ID NO: 12252 - DNA, 201 bp, Homo sapiens; identical to SEQ ID NO: 12199

SEQ ID NO: 12253 - DNA, 201 bp, Homo sapiens; identical to SEQ ID NO: 12148

SEQ ID NO: 12254 - DNA, 201 bp, Homo sapiens; identical to SEQ ID NO: 12149

SEQ ID NO: 12255 - DNA, 201 bp, Homo sapiens; identical to SEQ ID NO: 12150

SEQ ID NO: 12256 - DNA, 201 bp, Homo sapiens; identical to SEQ ID NO: 12146

SEQ ID NO: 12257 - DNA, 201 bp, Homo sapiens; identical to SEQ ID NO: 12151

SEQ ID NO: 12258 - DNA, 201 bp, Homo sapiens; identical to SEQ ID NO: 12153

SEQ ID NO: 12259 - DNA, 201 bp, Homo sapiens; identical to SEQ ID NO: 12154

SEQ ID NO: 12260 - DNA, 201 bp, Homo sapiens; identical to SEQ ID NO: 12155

SEQ ID NO: 12261 - DNA, 201 bp, Homo sapiens; identical to SEQ ID NO: 12156

SEQ ID NO: 12262 - DNA, 201 bp, Homo sapiens; identical to SEQ ID NO: 12157

SEQ ID NO: 12263 - DNA, 201 bp, Homo sapiens; identical to SEQ ID NO: 12158

SEQ ID NO: 12264 - DNA, 201 bp, Homo sapiens; identical to SEQ ID NO: 12159

SEQ ID NO: 12265 - DNA, 201 bp, Homo sapiens; identical to SEQ ID NO: 12142

SEQ ID NO: 12266 - DNA, 201 bp, Homo sapiens; identical to SEQ ID NO: 12161

SEQ ID NO: 12267 - DNA, 201 bp, Homo sapiens; identical to SEQ ID NO: 12143

SEQ ID NO: 12268 - DNA, 201 bp, Homo sapiens; identical to SEQ ID NO: 12162

SEQ ID NO: 12269 - DNA, 201 bp, Homo sapiens; identical to SEQ ID NO: 12164

SEQ ID NO: 12270 - DNA, 201 bp, Homo sapiens; identical to SEQ ID NO: 12165

SEQ ID NO: 12271 - DNA, 201 bp, Homo sapiens; identical to SEQ ID NO: 12166

SEQ ID NO: 12272 - DNA, 201 bp, Homo sapiens; identical to SEQ ID NO: 12167

SEQ ID NO: 12273 - DNA, 201 bp, Homo sapiens; identical to SEQ ID NO: 12168

SEQ ID NO: 12274 - DNA, 191 bp, Homo sapiens; identical to SEQ ID NO: 12169

SEQ ID NO: 12275 - DNA, 201 bp, Homo sapiens; identical to SEQ ID NO: 12170

SEQ ID NO: 12276 - DNA, 201 bp, Homo sapiens; identical to SEQ ID NO: 12139

SEQ ID NO: 12277 - DNA, 201 bp, Homo sapiens; identical to SEQ ID NO: 12172

SEQ ID NO: 12278 - DNA, 201 bp, Homo sapiens; identical to SEQ ID NO: 12173

SEQ ID NO: 12279 - DNA, 201 bp, Homo sapiens; identical to SEQ ID NO: 12174

SEQ ID NO: 12280 - DNA, 201 bp, Homo sapiens; identical to SEQ ID NO: 12175

SEQ ID NO: 12281 - DNA, 201 bp, Homo sapiens; identical to SEQ ID NO: 12176

SEQ ID NO: 12282 - DNA, 190 bp, Homo sapiens; identical to SEQ ID NO: 12177

SEQ ID NO: 12283 - DNA, 201 bp, Homo sapiens; identical to SEQ ID NO: 12178

SEQ ID NO: 12284 - DNA, 201 bp, Homo sapiens; identical to SEQ ID NO: 12179

SEQ ID NO: 12285 - DNA, 201 bp, Homo sapiens; identical to SEQ ID NO: 12180

SEQ ID NO: 12286 - DNA, 201 bp, Homo sapiens; identical to SEQ ID NO: 12145

SEQ ID NO: 12287 - DNA, 201 bp, Homo sapiens; identical to SEQ ID NO: 12181

SEQ ID NO: 12288 - DNA, 201 bp, Homo sapiens; identical to SEQ ID NO: 12182

SEQ ID NO: 12289 - DNA, 201 bp, Homo sapiens; identical to SEQ ID NO: 12183

SEQ ID NO: 12290 - DNA, 201 bp, Homo sapiens; identical to SEQ ID NO: 12184

SEQ ID NO: 12291 - DNA, 201 bp, Homo sapiens; identical to SEQ ID NO: 12185

SEQ ID NO: 12292 - DNA, 201 bp, Homo sapiens; identical to SEQ ID NO: 12186

SEQ ID NO: 12293 - DNA, 201 bp, Homo sapiens; identical to SEQ ID NO: 12187

SEQ ID NO: 12294 - DNA, 201 bp, Homo sapiens; identical to SEQ ID NO: 12188

SEQ ID NO: 12295 - DNA, 201 bp, Homo sapiens; identical to SEQ ID NO: 12189

SEQ ID NO: 12296 - DNA, 201 bp, Homo sapiens; identical to SEQ ID NO: 12243

SEQ ID NO: 12297 - DNA, 201 bp, Homo sapiens; identical to SEQ ID NO: 12191

SEQ ID NO: 12298 - DNA, 201 bp, Homo sapiens; identical to SEQ ID NO: 12192

SEQ ID NO: 12299 - DNA, 201 bp, Homo sapiens; identical to SEQ ID NO: 12140

SEQ ID NO: 12300 - DNA, 201 bp, Homo sapiens; identical to SEQ ID NO: 12247

SEQ ID NO: 12301 - DNA, 201 bp, Homo sapiens; identical to SEQ ID NO: 12195

SEQ ID NO: 12302 - DNA, 201 bp, Homo sapiens; identical to SEQ ID NO: 12196

SEQ ID NO: 12303 - DNA, 201 bp, Homo sapiens; identical to SEQ ID NO: 12197

SEQ ID NO: 12304 - DNA, 201 bp, Homo sapiens; identical to SEQ ID NO: 12198

SEQ ID NO: 12305 - DNA, 201 bp, Homo sapiens; identical to SEQ ID NO: 12199

SEQ ID NO: 12306 - DNA, 201 bp, Homo sapiens; identical to SEQ ID NO: 12148

SEQ ID NO: 12307 - DNA, 201 bp, Homo sapiens; identical to SEQ ID NO: 12149

SEQ ID NO: 12308 - DNA, 201 bp, Homo sapiens; identical to SEQ ID NO: 12150

SEQ ID NO: 12309 - DNA, 201 bp, Homo sapiens; identical to SEQ ID NO: 12146

SEQ ID NO: 12310 - DNA, 201 bp, Homo sapiens; identical to SEQ ID NO: 12151

SEQ ID NO: 12311 - DNA, 201 bp, Homo sapiens; identical to SEQ ID NO: 12153

SEQ ID NO: 12312 - DNA, 201 bp, Homo sapiens; identical to SEQ ID NO: 12154

SEQ ID NO: 12313 - DNA, 201 bp, Homo sapiens; identical to SEQ ID NO: 12155

SEQ ID NO: 12314 - DNA, 201 bp, Homo sapiens; identical to SEQ ID NO: 12156

SEQ ID NO: 12315 - DNA, 201 bp, Homo sapiens; identical to SEQ ID NO: 12157

SEQ ID NO: 12316 - DNA, 201 bp, Homo sapiens; identical to SEQ ID NO: 12158

SEQ ID NO: 12317 - DNA, 201 bp, Homo sapiens; identical to SEQ ID NO: 12159

SEQ ID NO: 12318 - DNA, 201 bp, Homo sapiens; identical to SEQ ID NO: 12142

SEQ ID NO: 12319 - DNA, 201 bp, Homo sapiens; identical to SEQ ID NO: 12161

SEQ ID NO: 12320 - DNA, 201 bp, Homo sapiens; identical to SEQ ID NO: 12143

SEQ ID NO: 12321 - DNA, 201 bp, Homo sapiens; identical to SEQ ID NO: 12162

SEQ ID NO: 12322 - DNA, 201 bp, Homo sapiens; identical to SEQ ID NO: 12164

SEQ ID NO: 12323 - DNA, 201 bp, Homo sapiens; identical to SEQ ID NO: 12165

SEQ ID NO: 12324 - DNA, 201 bp, Homo sapiens; identical to SEQ ID NO: 12166

SEQ ID NO: 12325 - DNA, 201 bp, Homo sapiens; identical to SEQ ID NO: 12167

SEQ ID NO: 12326 - DNA, 201 bp, Homo sapiens; identical to SEQ ID NO: 12168

SEQ ID NO: 12327 - DNA, 191 bp, Homo sapiens; identical to SEQ ID NO: 12169

SEQ ID NO: 12328 - DNA, 201 bp, Homo sapiens; identical to SEQ ID NO: 12170

SEQ ID NO: 12329 - DNA, 201 bp, Homo sapiens; identical to SEQ ID NO: 12139

SEQ ID NO: 12330 - DNA, 201 bp, Homo sapiens; identical to SEQ ID NO: 12172

SEQ ID NO: 12331 - DNA, 201 bp, Homo sapiens; identical to SEQ ID NO: 12173

SEQ ID NO: 12332 - DNA, 201 bp, Homo sapiens; identical to SEQ ID NO: 12174

SEQ ID NO: 12333 - DNA, 201 bp, Homo sapiens; identical to SEQ ID NO: 12175

SEQ ID NO: 12334 - DNA, 201 bp, Homo sapiens; identical to SEQ ID NO: 12176

SEQ ID NO: 12335 - DNA, 190 bp, Homo sapiens; identical to SEQ ID NO: 12177

SEQ ID NO: 12336 - DNA, 201 bp, Homo sapiens; identical to SEQ ID NO: 12178

SEQ ID NO: 12337 - DNA, 201 bp, Homo sapiens; identical to SEQ ID NO: 12179

SEQ ID NO: 12338 - DNA, 201 bp, Homo sapiens; identical to SEQ ID NO: 12180

SEQ ID NO: 12339 - DNA, 201 bp, Homo sapiens; identical to SEQ ID NO: 12145

SEQ ID NO: 12340 - DNA, 201 bp, Homo sapiens; identical to SEQ ID NO: 12181

SEQ ID NO: 12341 - DNA, 201 bp, Homo sapiens; identical to SEQ ID NO: 12182

SEQ ID NO: 12342 - DNA, 201 bp, Homo sapiens; identical to SEQ ID NO: 12183

SEQ ID NO: 12343 - DNA, 201 bp, Homo sapiens; identical to SEQ ID NO: 12184

SEQ ID NO: 12344 - DNA, 201 bp, Homo sapiens; identical to SEQ ID NO: 12185

SEQ ID NO: 12345 - DNA, 201 bp, Homo sapiens; identical to SEQ ID NO: 12186

SEQ ID NO: 12346 - DNA, 201 bp, Homo sapiens; identical to SEQ ID NO: 12187

SEQ ID NO: 12347 - DNA, 201 bp, Homo sapiens; identical to SEQ ID NO: 12188

SEQ ID NO: 12348 - DNA, 201 bp, Homo sapiens; identical to SEQ ID NO: 12189

SEQ ID NO: 12349 - DNA, 201 bp, Homo sapiens; identical to SEQ ID NO: 12147

SEQ ID NO: 12350 - DNA, 201 bp, Homo sapiens; identical to SEQ ID NO: 12191

SEQ ID NO: 12351 - DNA, 201 bp, Homo sapiens; identical to SEQ ID NO: 12192

SEQ ID NO: 12352 - DNA, 201 bp, Homo sapiens; identical to SEQ ID NO: 12140

SEQ ID NO: 12353 - DNA, 201 bp, Homo sapiens; identical to SEQ ID NO: 12141

SEQ ID NO: 12354 - DNA, 201 bp, Homo sapiens; identical to SEQ ID NO: 12195

SEQ ID NO: 12355 - DNA, 201 bp, Homo sapiens; identical to SEQ ID NO: 12196

SEQ ID NO: 12356 - DNA, 201 bp, Homo sapiens; identical to SEQ ID NO: 12197

SEQ ID NO: 12357 - DNA, 201 bp, Homo sapiens; identical to SEQ ID NO: 12198

SEQ ID NO: 12358 - DNA, 201 bp, Homo sapiens; identical to SEQ ID NO: 12199

SEQ ID NO: 12359 - DNA, 201 bp, Homo sapiens
gtgggactgcccggggctgccaggacagcactactgcggccacaaagaggacgcgggcgcggtgtgctcagagcaccagtcctggcgcctgacagggggcrctgaccgctgcgaggggcaggtggaggtacacttccgaggggtctggaacacagtgtgtgacagtgagtggtacccatcggaggccaaggtgctctgcca

SEQ ID NO: 12360 - DNA, 201 bp, Homo sapiens
ctgccccactccttgtccggcaggatgtactactcatgcaatggggaggagctcaccctctccaactgctcctggcggttcaacaactccaacctctgcarccagtcgctggcagccagggtcctctgctcagcttcccggagtttgcacaatctgtccactcccgaagtccctgcaagtgttcagacagtcactatagaa

SEQ ID NO: 12361 - DNA, 201 bp, Homo sapiens
cccacatcccaactgccaaccctggacactgcattacagacccgccatccctgggccctcagtatcacccgaggagcaacagtgagtcgagcacctcttcrggggaggattactgcaatagtcccaaaagcaagctgcctccatggaacccccaggtgttttcttcagagaggagttccttcctggagcagcccccaaact

SEQ ID NO: 12362 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagcagggcccccggctgatgacagctccagcacctcatccggggagtggtaccagaacttccagccaccaccccagcccc

SEQ ID NO: 12363 - DNA, 201 bp, Homo sapiens
cctggaggacgcccacgtggtgtgcaggcaactgggctgcggctgggcagtccaggccctgcccggcttgcacttcacgcccggccgcgggcctatccacygggaccaggtgaactgctcgggggccgaagcttacctgtgggactgcccggggctgccaggacagcactactgcggccacaaagaggacgcgggcgcggt

SEQ ID NO: 12364 - DNA, 201 bp, Homo sapiens
gagctaatgctcctcatcccctccatcgttctgggaattctcctccttggctccctcatcttcatagccttcatcctcttgagaattaaaggaaaatatgrcctccccgtaatggtgaaccaccagcacctacccaccaccatcccggcagggagcaatagctatcaaccggtccccatcaccatccccaaagaagttttc

SEQ ID NO: 12365 - DNA, 201 bp, Homo sapiens
gggagcaatagctatcaaccggtccccatcaccatccccaaagaagttttcatgctgcccatccaggtccaggccccgccccctgaggactcagactctgrctcggactcagactatgagcactatgacttcagcgcccagcctcctgtggccctgaccaccttctacaattcccagcggcatcgggtcacagatgaggag

SEQ ID NO: 12366 - DNA, 201 bp, Homo sapiens
ctgcaatagtcccaaaagcaagctgcctccatggaacccccaggtgttttcttcagagaggagttccttcctggagcagcccccaaacttggagctggccrgcacccagccagccttttcagcagggcccccggctgatgacagctccagcacctcatccggggagtggtaccagaacttccagccaccaccccagccccc

SEQ ID NO: 12367 - DNA, 201 bp, Homo sapiens
tcagtgtgcgatgacacttgggacctggaggacgcccacgtggtgtgcaggcaactgggctgcggctgggcagtccaggccctgcccggcttgcacttcaygcccggccgcgggcctatccaccgggaccaggtgaactgctcgggggccgaagcttacctgtgggactgcccggggctgccaggacagcactactgcggc

SEQ ID NO: 12368 - DNA, 201 bp, Homo sapiens
caccgggaccaggtgaactgctcgggggccgaagcttacctgtgggactgcccggggctgccaggacagcactactgcggccacaaagaggacgcgggcgyggtgtgctcagagcaccagtcctggcgcctgacagggggcgctgaccgctgcgaggggcaggtggaggtacacttccgaggggtctggaacacagtgtgt

SEQ ID NO: 12369 - DNA, 201 bp, Homo sapiens; identical to SEQ ID NO: 12359

SEQ ID NO: 12370 - DNA, 201 bp, Homo sapiens; identical to SEQ ID NO: 12360

SEQ ID NO: 12371 - DNA, 201 bp, Homo sapiens; identical to SEQ ID NO: 12361

SEQ ID NO: 12372 - DNA, 185 bp, Homo sapiens
actgcaatagtcccaaaagcaagctgcctccatggaacccccaggtgttttcttcagagaggagttccttcctggagcagcccccaaacttggagctggcyggcacccagccagccttttcagggtcccccagccctcagcctgactccaccgacaacgatgactacgatgacatcagcgcagcc

SEQ ID NO: 12373 - DNA, 201 bp, Homo sapiens; identical to SEQ ID NO: 12363

SEQ ID NO: 12374 - DNA, 201 bp, Homo sapiens
ctcatcttcatagccttcatcctcttgagaattaaaggaaaatatgttttcatgctgcccatccaggtccaggccccgccccctgaggactcagactctgrctcggactcagactatgagcactatgacttcagcgcccagcctcctgtggccctgaccaccttctacaattcccagcggcatcgggtcacagatgaggag

SEQ ID NO: 12375 - DNA, 184 bp, Homo sapiens
ctgcaatagtcccaaaagcaagctgcctccatggaacccccaggtgttttcttcagagaggagttccttcctggagcagcccccaaacttggagctggccrgcacccagccagccttttcagggtcccccagccctcagcctgactccaccgacaacgatgactacgatgacatcagcgcagcc

SEQ ID NO: 12376 - DNA, 201 bp, Homo sapiens; identical to SEQ ID NO: 12367

SEQ ID NO: 12377 - DNA, 201 bp, Homo sapiens; identical to SEQ ID NO: 12368

SEQ ID NO: 12378 - DNA, 201 bp, Homo sapiens; identical to SEQ ID NO: 12359

SEQ ID NO: 12379 - DNA, 201 bp, Homo sapiens; identical to SEQ ID NO: 12360

SEQ ID NO: 12380 - DNA, 201 bp, Homo sapiens; identical to SEQ ID NO: 12361

SEQ ID NO: 12381 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagggtcccccagccctcagcctgactccaccgacaacgatgactacgatgacatcagcgcagcctaggccggggccagcc

SEQ ID NO: 12382 - DNA, 201 bp, Homo sapiens; identical to SEQ ID NO: 12363

SEQ ID NO: 12383 - DNA, 201 bp, Homo sapiens
gagctaatgctcctcatcccctccatcgttctgggaattctcctccttggctccctcatcttcatagccttcatcctcttgagaattaaaggaaaatatgrcctccccgtaatggtgaaccaccagcacctacccaccaccatcccggcagggagcaatagctatcaaccggtccccatcaccatccccaaagaagattcc

SEQ ID NO: 12384 - DNA, 201 bp, Homo sapiens
ctgcaatagtcccaaaagcaagctgcctccatggaacccccaggtgttttcttcagagaggagttccttcctggagcagcccccaaacttggagctggccrgcacccagccagccttttcagggtcccccagccctcagcctgactccaccgacaacgatgactacgatgacatcagcgcagcctaggccggggccagccg

SEQ ID NO: 12385 - DNA, 201 bp, Homo sapiens; identical to SEQ ID NO: 12367

SEQ ID NO: 12386 - DNA, 201 bp, Homo sapiens; identical to SEQ ID NO: 12368

SEQ ID NO: 12387 - DNA, 201 bp, Homo sapiens; identical to SEQ ID NO: 12359

SEQ ID NO: 12388 - DNA, 201 bp, Homo sapiens; identical to SEQ ID NO: 12360

SEQ ID NO: 12389 - DNA, 201 bp, Homo sapiens; identical to SEQ ID NO: 12361

SEQ ID NO: 12390 - DNA, 201 bp, Homo sapiens; identical to SEQ ID NO: 12362

SEQ ID NO: 12391 - DNA, 201 bp, Homo sapiens; identical to SEQ ID NO: 12363

SEQ ID NO: 12392 - DNA, 201 bp, Homo sapiens; identical to SEQ ID NO: 12366

SEQ ID NO: 12393 - DNA, 201 bp, Homo sapiens; identical to SEQ ID NO: 12367

SEQ ID NO: 12394 - DNA, 201 bp, Homo sapiens; identical to SEQ ID NO: 12368

SEQ ID NO: 12395 - DNA, 201 bp, Homo sapiens; identical to SEQ ID NO: 12359

SEQ ID NO: 12396 - DNA, 201 bp, Homo sapiens; identical to SEQ ID NO: 12360

SEQ ID NO: 12397 - DNA, 201 bp, Homo sapiens; identical to SEQ ID NO: 12361

SEQ ID NO: 12398 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagggcccccggctgatgacagctccagcacctcatccggggagtggtaccagaacttccagccaccaccccagccccctt

SEQ ID NO: 12399 - DNA, 201 bp, Homo sapiens; identical to SEQ ID NO: 12363

SEQ ID NO: 12400 - DNA, 201 bp, Homo sapiens; identical to SEQ ID NO: 12374

SEQ ID NO: 12401 - DNA, 201 bp, Homo sapiens
ctgcaatagtcccaaaagcaagctgcctccatggaacccccaggtgttttcttcagagaggagttccttcctggagcagcccccaaacttggagctggccrgcacccagccagccttttcagggcccccggctgatgacagctccagcacctcatccggggagtggtaccagaacttccagccaccaccccagcccccttc

SEQ ID NO: 12402 - DNA, 201 bp, Homo sapiens; identical to SEQ ID NO: 12367

SEQ ID NO: 12403 - DNA, 201 bp, Homo sapiens; identical to SEQ ID NO: 12368

SEQ ID NO: 12404 - DNA, 201 bp, Homo sapiens
ttcagcaaggagcaacgaggagtagcccagcccctggcccagcttcgaagctgcccccaggaggagggccccagggggcggggcttggctgctaggccccytgaaaacagagcaggggggcctgtggcacgttcagaggagcctggtgccccgctgcccgtggccgtcggcactgccgagccagggggcagtatgaagacc

SEQ ID NO: 12405 - DNA, 181 bp, Homo sapiens
gcggcaagaatgtctagcctgcccgcccgcatggccagccagtggcaagctgccgcccccactctccgggcaccgtctcctgcctgtgcgtccgcccaccrctgccctgtctgttgcgacaccctcccccccacatacacacgcagcgttttgataaattattggttttcaacgatcctga

SEQ ID NO: 12406 - DNA, 201 bp, Homo sapiens
cactggggatctcaccagaaaggaaccgacggagctaggggccagcgagatggcggacgaggccttagctgggctggatgagggagcccttcggaagctgstggaggtcacagcagatctggcagagcggcggcgcatccgctcagccatccgggaactgcagcggcaggagctggagcgcgaggaggaggccctggcatc

SEQ ID NO: 12407 - DNA, 201 bp, Homo sapiens
catgtcaccagcttcagccatgccccccccagtagccgaggaggctgcagcatcaagatggaaccagagccagcagagcctctcgctgcagcagtggaagyggccaatggggctgagcagacccgagtgaacaaagcaccagaagggcggagccctctgagcgctgaggagctgatgactattgaggatgaaggagtcttg

SEQ ID NO: 12408 - DNA, 201 bp, Homo sapiens
accagagccagcagagcctctcgctgcagcagtggaagcggccaatggggctgagcagacccgagtgaacaaagcaccagaagggcggagccctctgagcrctgaggagctgatgactattgaggatgaaggagtcttggacaagatgctggatcagagcacggactttgaagagcggaagctcatccgggctgcacttcg

SEQ ID NO: 12409 - DNA, 201 bp, Homo sapiens
ccgggctgcacttcgtgagctccgacaaaggaagagagaccagcgggacaaggagcgggaacggcggctgcaggaggcacggggccggccaggggaggggygcggcaacacagccactgagaccaccacgaggcacagccagcgggcagctgatggctctgctgtcagcactgttaccaagactgagcggctcgtccactc

SEQ ID NO: 12410 - DNA, 201 bp, Homo sapiens
cctatgtgcagtcgctctacaaccacctgcgacgccacgaactgcgcctgcgcggcaagaatgtctagcctgcccgcccgcatggccagccagtggcaagstgccgcccccactctccgggcaccgtctcctgcctgtgcgtccgcccaccgctgccctgtctgttgcgacaccctcccccccacatacacacgcagcgtt

SEQ ID NO: 12411 - DNA, 201 bp, Homo sapiens
agctgaggttccaggcagcccagagccaccccccagcccacccaagaccaccagccctgagcctcaggagtctccaacgctccccagcactgagggccagktggtcaacaagcttctgtctggccccaaagagacccctgctgcccagagccccaccagaggcccctctgacaccaagagagcagacgtggctggaccccg

SEQ ID NO: 12412 - DNA, 201 bp, Homo sapiens
acggccgtggccaggcctccacaggccgggtgctgctgcccacaggcaaccagagggcagaactgacactggggctgcgggcgcccccgaccctactcagyaccagtagtgggggcaagagcaccatcacccgtgtcaacagccctgggaccctggctcggctgggcagtgtcactcatgtcaccagcttcagccatgccc

SEQ ID NO: 12413 - DNA, 201 bp, Homo sapiens
gagcctcaggagtctccaacgctccccagcactgagggccaggtggtcaacaagcttctgtctggccccaaagagacccctgctgcccagagccccaccaraggcccctctgacaccaagagagcagacgtggctggaccccgaccctgccaacgctccctgtcggtgctcagcccccgccaaccagcccagaaccgagag

SEQ ID NO: 12414 - DNA, 201 bp, Homo sapiens
ctggaaccagagaccccctaccctgggtttgaattctctgagctggtgacaggtgccacaggcactggggatctcaccagaaaggaaccgacggagctagrggccagcgagatggcggacgaggccttagctgggctggatgagggagcccttcggaagctgctggaggtcacagcagatctggcagagcggcggcgcatc

SEQ ID NO: 12415 - DNA, 201 bp, Homo sapiens
cagccctgggaccctggctcggctgggcagtgtcactcatgtcaccagcttcagccatgccccccccagtagccgaggaggctgcagcatcaagatggaascagagccagcagagcctctcgctgcagcagtggaagcggccaatggggctgagcagacccgagtgaacaaagcaccagaagggcggagccctctgagcgc

SEQ ID NO: 12416 - DNA, 201 bp, Homo sapiens
caccagaagggcggagccctctgagcgctgaggagctgatgactattgaggatgaaggagtcttggacaagatgctggatcagagcacggactttgaagarcggaagctcatccgggctgcacttcgtgagctccgacaaaggaagagagaccagcgggacaaggagcgggaacggcggctgcaggaggcacggggccggc

SEQ ID NO: 12417 - DNA, 201 bp, Homo sapiens
ttcaccatcgagatcaaggacggccgtggccaggcctccacaggccgggtgctgctgcccacaggcaaccagagggcagaactgacactggggctgcgggygcccccgaccctactcagcaccagtagtgggggcaagagcaccatcacccgtgtcaacagccctgggaccctggctcggctgggcagtgtcactcatgtc

SEQ ID NO: 12418 - DNA, 201 bp, Homo sapiens
tgcgacgccacgaactgcgcctgcgcggcaagaatgtctagcctgcccgcccgcatggccagccagtggcaagctgccgcccccactctccgggcaccgtytcctgcctgtgcgtccgcccaccgctgccctgtctgttgcgacaccctcccccccacatacacacgcagcgttttgataaattattggttttcaacgatc

SEQ ID NO: 12419 - DNA, 201 bp, Homo sapiens
tctcagggcttggaaggtagaagcatgctacaagaaggcaatgtctgttcaaaggtttagacaggatgagagtccatcccaggccacacagcagactggcrgccaagctggcagggctggaaccagagaccccctaccctgggtttgaattctctgagctggtgacaggtgccacaggcactggggatctcaccagaaagg

SEQ ID NO: 12420 - DNA, 201 bp, Homo sapiens
gctgctaggccccttgaaaacagagcaggggggcctgtggcacgttcagaggagcctggtgccccgctgcccgtggccgtcggcactgccgagccaggggrcagtatgaagaccacattcaccatcgagatcaaggacggccgtggccaggcctccacaggccgggtgctgctgcccacaggcaaccagagggcagaactg

SEQ ID NO: 12421 - DNA, 201 bp, Homo sapiens; identical to SEQ ID NO: 12404

SEQ ID NO: 12422 - DNA, 181 bp, Homo sapiens; identical to SEQ ID NO: 12405

SEQ ID NO: 12423 - DNA, 201 bp, Homo sapiens; identical to SEQ ID NO: 12406

SEQ ID NO: 12424 - DNA, 201 bp, Homo sapiens; identical to SEQ ID NO: 12407

SEQ ID NO: 12425 - DNA, 201 bp, Homo sapiens; identical to SEQ ID NO: 12408

SEQ ID NO: 12426 - DNA, 201 bp, Homo sapiens; identical to SEQ ID NO: 12409

SEQ ID NO: 12427 - DNA, 201 bp, Homo sapiens; identical to SEQ ID NO: 12410

SEQ ID NO: 12428 - DNA, 201 bp, Homo sapiens; identical to SEQ ID NO: 12411

SEQ ID NO: 12429 - DNA, 201 bp, Homo sapiens; identical to SEQ ID NO: 12412

SEQ ID NO: 12430 - DNA, 201 bp, Homo sapiens; identical to SEQ ID NO: 12413

SEQ ID NO: 12431 - DNA, 201 bp, Homo sapiens; identical to SEQ ID NO: 12414

SEQ ID NO: 12432 - DNA, 201 bp, Homo sapiens; identical to SEQ ID NO: 12415

SEQ ID NO: 12433 - DNA, 201 bp, Homo sapiens; identical to SEQ ID NO: 12416

SEQ ID NO: 12434 - DNA, 201 bp, Homo sapiens; identical to SEQ ID NO: 12417

SEQ ID NO: 12435 - DNA, 201 bp, Homo sapiens; identical to SEQ ID NO: 12418

SEQ ID NO: 12436 - DNA, 201 bp, Homo sapiens; identical to SEQ ID NO: 12419

SEQ ID NO: 12437 - DNA, 201 bp, Homo sapiens; identical to SEQ ID NO: 12420

SEQ ID NO: 12438 - DNA, 201 bp, Homo sapiens
actagccgggagctcagccgggaaagggatccccaagcgggccacccggctgcccagatggaaccagagccagcagagcctctcgctgcagcagtggaagyggccaatggggctgagcagacccgagtgaacaaagcaccagaagggcggagccctctgagcgctgaggagctgatgactattgaggatgaaggagtcttg

SEQ ID NO: 12439 - DNA, 174 bp, Homo sapiens
gcggcaagaatgtctagcctgcccgcccgcatggccagccagtggcaagctgccgcccccactctccgggcaccgtctcctgcctgtgcgtccgcccaccrctgccctgtctgttgcgacaccctcccccccacatacacacgcagcgttttgataaattattggttttcaacg

SEQ ID NO: 12440 - DNA, 201 bp, Homo sapiens; identical to SEQ ID NO: 12408

SEQ ID NO: 12441 - DNA, 201 bp, Homo sapiens; identical to SEQ ID NO: 12410

SEQ ID NO: 12442 - DNA, 201 bp, Homo sapiens
cgcagctcctggatacagaggacatggtgcggcttcgagagcctgactggaagtgcgtgtacacgtacatccaggaattctaccgctgtctggtccagaargggctggtaaaaaccaaaaagtcctaacccctgctcggggccccacggatgctggtggactgtgtgcccctggtggaggtggacgacatgatgatcatgg

SEQ ID NO: 12443 - DNA, 187 bp, Homo sapiens
attcattcccaagcccaggatccactagccgggagctcagccgggaaagggatccccaagcgggccacccggctgcccagatggaascagagccagcagagcctctcgctgcagcagtggaagcggccaatggggctgagcagacccgagtgaacaaagcaccagaagggcggagccctctgagcgc

SEQ ID NO: 12444 - DNA, 201 bp, Homo sapiens
caccagaagggcggagccctctgagcgctgaggagctgatgactattgaggatgaaggagtcttggacaagatgctggatcagagcacggactttgaagarcggaagctcatccgggctgcacttcgtgagctccgacaaaggaagagagatggcagtggcagcaccatgatgcaaaccaagaccttctcctcttcctcct

SEQ ID NO: 12445 - DNA, 198 bp, Homo sapiens
tgcgacgccacgaactgcgcctgcgcggcaagaatgtctagcctgcccgcccgcatggccagccagtggcaagctgccgcccccactctccgggcaccgtytcctgcctgtgcgtccgcccaccgctgccctgtctgttgcgacaccctcccccccacatacacacgcagcgttttgataaattattggttttcaacg

SEQ ID NO: 12446 - DNA, 201 bp, Homo sapiens; identical to SEQ ID NO: 12412

SEQ ID NO: 12447 - DNA, 201 bp, Homo sapiens; identical to SEQ ID NO: 12413

SEQ ID NO: 12448 - DNA, 201 bp, Homo sapiens
cctgcgccggacgggtgggctggactgagagaattctctgagctggtgacaggtgccacaggcactggggatctcaccagaaaggaaccgacggagctagrggccagcgagatggcggacgaggccttagctgggctggatgagggagcccttcggaagctgctggaggtcacagcagatctggcagagcggcggcgcatc

SEQ ID NO: 12449 - DNA, 201 bp, Homo sapiens; identical to SEQ ID NO: 12415

SEQ ID NO: 12450 - DNA, 112 bp, Homo sapiens
cgcagaatccargggacggttgctgagcgggcctgggacagcgggtcgcggcacctccggcctgcgcgtgtctaatccgtctgtcgggtcccgaaagagctaagccgagcct

SEQ ID NO: 12451 - DNA, 201 bp, Homo sapiens; identical to SEQ ID NO: 12417

SEQ ID NO: 12452 - DNA, 201 bp, Homo sapiens; identical to SEQ ID NO: 12418

SEQ ID NO: 12453 - DNA, 201 bp, Homo sapiens; identical to SEQ ID NO: 12420

SEQ ID NO: 12454 - DNA, 201 bp, Homo sapiens; identical to SEQ ID NO: 12404

SEQ ID NO: 12455 - DNA, 181 bp, Homo sapiens; identical to SEQ ID NO: 12405

SEQ ID NO: 12456 - DNA, 201 bp, Homo sapiens; identical to SEQ ID NO: 12407

SEQ ID NO: 12457 - DNA, 201 bp, Homo sapiens; identical to SEQ ID NO: 12406

SEQ ID NO: 12458 - DNA, 201 bp, Homo sapiens; identical to SEQ ID NO: 12408

SEQ ID NO: 12459 - DNA, 201 bp, Homo sapiens; identical to SEQ ID NO: 12409

SEQ ID NO: 12460 - DNA, 201 bp, Homo sapiens; identical to SEQ ID NO: 12410

SEQ ID NO: 12461 - DNA, 159 bp, Homo sapiens
cgcagaatccaggggacggttgctgagcgggcctgggacagcgggtcgcggcacctccsgcctgcgcgtgtctaatccgtctgtcgggtcccgaaagagctaagccgagcctgcgccggacgggtgggctggactgagagaattctctgagctggtgac

SEQ ID NO: 12462 - DNA, 201 bp, Homo sapiens; identical to SEQ ID NO: 12411

SEQ ID NO: 12463 - DNA, 201 bp, Homo sapiens; identical to SEQ ID NO: 12416

SEQ ID NO: 12464 - DNA, 201 bp, Homo sapiens; identical to SEQ ID NO: 12412

SEQ ID NO: 12465 - DNA, 201 bp, Homo sapiens; identical to SEQ ID NO: 12442

SEQ ID NO: 12466 - DNA, 201 bp, Homo sapiens; identical to SEQ ID NO: 12413

SEQ ID NO: 12467 - DNA, 201 bp, Homo sapiens; identical to SEQ ID NO: 12414

SEQ ID NO: 12468 - DNA, 201 bp, Homo sapiens; identical to SEQ ID NO: 12415

SEQ ID NO: 12469 - DNA, 201 bp, Homo sapiens; identical to SEQ ID NO: 12417

SEQ ID NO: 12470 - DNA, 201 bp, Homo sapiens; identical to SEQ ID NO: 12418

SEQ ID NO: 12471 - DNA, 201 bp, Homo sapiens; identical to SEQ ID NO: 12420

SEQ ID NO: 12472 - DNA, 201 bp, Homo sapiens; identical to SEQ ID NO: 12404

SEQ ID NO: 12473 - DNA, 181 bp, Homo sapiens; identical to SEQ ID NO: 12405

SEQ ID NO: 12474 - DNA, 201 bp, Homo sapiens; identical to SEQ ID NO: 12407

SEQ ID NO: 12475 - DNA, 201 bp, Homo sapiens; identical to SEQ ID NO: 12406

SEQ ID NO: 12476 - DNA, 201 bp, Homo sapiens; identical to SEQ ID NO: 12408

SEQ ID NO: 12477 - DNA, 201 bp, Homo sapiens; identical to SEQ ID NO: 12409

SEQ ID NO: 12478 - DNA, 201 bp, Homo sapiens; identical to SEQ ID NO: 12410

SEQ ID NO: 12479 - DNA, 201 bp, Homo sapiens; identical to SEQ ID NO: 12411

SEQ ID NO: 12480 - DNA, 201 bp, Homo sapiens; identical to SEQ ID NO: 12416

SEQ ID NO: 12481 - DNA, 201 bp, Homo sapiens; identical to SEQ ID NO: 12419

SEQ ID NO: 12482 - DNA, 201 bp, Homo sapiens; identical to SEQ ID NO: 12404

SEQ ID NO: 12483 - DNA, 201 bp, Homo sapiens
ctgcacttcgtgagctccgacaaaggaagagaggtagagagccagttgccctaccctagatccagctgccccattccccagctgctcccctcatactctgrggtccatttgtggacaccccagcttaataactgccctacccagcttctccttctctagacccagcagttcccttggctattccctgctggatccagctgc

SEQ ID NO: 12484 - DNA, 201 bp, Homo sapiens; identical to SEQ ID NO: 12407

SEQ ID NO: 12485 - DNA, 201 bp, Homo sapiens; identical to SEQ ID NO: 12406

SEQ ID NO: 12486 - DNA, 201 bp, Homo sapiens; identical to SEQ ID NO: 12408

SEQ ID NO: 12487 - DNA, 201 bp, Homo sapiens; identical to SEQ ID NO: 12411

SEQ ID NO: 12488 - DNA, 157 bp, Homo sapiens
cagaatccaggggacggttgctgagcgggcctgggacagcgggtcgcggcacctccsgcctgcgcgtgtctaatccgtctgtcgggtcccgaaagagctaagccgagcctgcgccggacgggtgggctggactgagagaattctctgagctggtgac

SEQ ID NO: 12489 - DNA, 201 bp, Homo sapiens; identical to SEQ ID NO: 12412

SEQ ID NO: 12490 - DNA, 201 bp, Homo sapiens; identical to SEQ ID NO: 12413

SEQ ID NO: 12491 - DNA, 201 bp, Homo sapiens; identical to SEQ ID NO: 12448

SEQ ID NO: 12492 - DNA, 201 bp, Homo sapiens; identical to SEQ ID NO: 12415

SEQ ID NO: 12493 - DNA, 201 bp, Homo sapiens; identical to SEQ ID NO: 12417

SEQ ID NO: 12494 - DNA, 201 bp, Homo sapiens
caccagaagggcggagccctctgagcgctgaggagctgatgactattgaggatgaaggagtcttggacaagatgctggatcagagcacggactttgaagarcggaagctcatccgggctgcacttcgtgagctccgacaaaggaagagaggtagagagccagttgccctaccctagatccagctgccccattccccagctg

SEQ ID NO: 12495 - DNA, 110 bp, Homo sapiens
cagaatccargggacggttgctgagcgggcctgggacagcgggtcgcggcacctccggcctgcgcgtgtctaatccgtctgtcgggtcccgaaagagctaagccgagcct

SEQ ID NO: 12496 - DNA, 201 bp, Homo sapiens; identical to SEQ ID NO: 12420

SEQ ID NO: 12497 - DNA, 201 bp, Homo sapiens; identical to SEQ ID NO: 12412

SEQ ID NO: 12498 - DNA, 201 bp, Homo sapiens; identical to SEQ ID NO: 12442

SEQ ID NO: 12499 - DNA, 201 bp, Homo sapiens; identical to SEQ ID NO: 12413

SEQ ID NO: 12500 - DNA, 201 bp, Homo sapiens; identical to SEQ ID NO: 12448

SEQ ID NO: 12501 - DNA, 201 bp, Homo sapiens; identical to SEQ ID NO: 12415

SEQ ID NO: 12502 - DNA, 112 bp, Homo sapiens; identical to SEQ ID NO: 12450

SEQ ID NO: 12503 - DNA, 201 bp, Homo sapiens; identical to SEQ ID NO: 12417

SEQ ID NO: 12504 - DNA, 201 bp, Homo sapiens; identical to SEQ ID NO: 12418

SEQ ID NO: 12505 - DNA, 201 bp, Homo sapiens; identical to SEQ ID NO: 12420

SEQ ID NO: 12506 - DNA, 201 bp, Homo sapiens; identical to SEQ ID NO: 12404

SEQ ID NO: 12507 - DNA, 181 bp, Homo sapiens; identical to SEQ ID NO: 12405

SEQ ID NO: 12508 - DNA, 201 bp, Homo sapiens; identical to SEQ ID NO: 12407

SEQ ID NO: 12509 - DNA, 201 bp, Homo sapiens; identical to SEQ ID NO: 12406

SEQ ID NO: 12510 - DNA, 201 bp, Homo sapiens; identical to SEQ ID NO: 12408

SEQ ID NO: 12511 - DNA, 201 bp, Homo sapiens; identical to SEQ ID NO: 12409

SEQ ID NO: 12512 - DNA, 201 bp, Homo sapiens; identical to SEQ ID NO: 12410

SEQ ID NO: 12513 - DNA, 159 bp, Homo sapiens; identical to SEQ ID NO: 12461

SEQ ID NO: 12514 - DNA, 201 bp, Homo sapiens; identical to SEQ ID NO: 12411

SEQ ID NO: 12515 - DNA, 201 bp, Homo sapiens; identical to SEQ ID NO: 12416

SEQ ID NO: 12516 - DNA, 201 bp, Homo sapiens; identical to SEQ ID NO: 12412

SEQ ID NO: 12517 - DNA, 201 bp, Homo sapiens; identical to SEQ ID NO: 12413

SEQ ID NO: 12518 - DNA, 201 bp, Homo sapiens; identical to SEQ ID NO: 12448

SEQ ID NO: 12519 - DNA, 201 bp, Homo sapiens; identical to SEQ ID NO: 12415

SEQ ID NO: 12520 - DNA, 112 bp, Homo sapiens; identical to SEQ ID NO: 12450

SEQ ID NO: 12521 - DNA, 201 bp, Homo sapiens; identical to SEQ ID NO: 12417

SEQ ID NO: 12522 - DNA, 201 bp, Homo sapiens; identical to SEQ ID NO: 12418

SEQ ID NO: 12523 - DNA, 201 bp, Homo sapiens; identical to SEQ ID NO: 12420

SEQ ID NO: 12524 - DNA, 201 bp, Homo sapiens; identical to SEQ ID NO: 12404

SEQ ID NO: 12525 - DNA, 181 bp, Homo sapiens; identical to SEQ ID NO: 12405

SEQ ID NO: 12526 - DNA, 201 bp, Homo sapiens; identical to SEQ ID NO: 12407

SEQ ID NO: 12527 - DNA, 201 bp, Homo sapiens; identical to SEQ ID NO: 12406

SEQ ID NO: 12528 - DNA, 201 bp, Homo sapiens; identical to SEQ ID NO: 12408

SEQ ID NO: 12529 - DNA, 201 bp, Homo sapiens; identical to SEQ ID NO: 12409

SEQ ID NO: 12530 - DNA, 201 bp, Homo sapiens; identical to SEQ ID NO: 12410

SEQ ID NO: 12531 - DNA, 159 bp, Homo sapiens; identical to SEQ ID NO: 12461

SEQ ID NO: 12532 - DNA, 201 bp, Homo sapiens; identical to SEQ ID NO: 12411

SEQ ID NO: 12533 - DNA, 201 bp, Homo sapiens; identical to SEQ ID NO: 12416

SEQ ID NO: 12534 - DNA, 201 bp, Homo sapiens
ggaggagctgcgccgcagcctggctccctatgctcaggacacgcaggagaagctcaaccaccagcttgagggcctgaccttccagatgaagaagaacgccraggagctcaaggccaggatctcggccagtgccgaggagctgcggcagaggctggcgcccttggccgaggacgtgcgtggcaacctgaggggcaacaccga

SEQ ID NO: 12535 - DNA, 201 bp, Homo sapiens
caggtcaacacgcaggccgagcagctgcggcgccagctgaccccctacgcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaag

SEQ ID NO: 12536 - DNA, 201 bp, Homo sapiens
aggccgtggaacatctccagaaatctgaactcacccagcaactcaatgccctcttccaggacaaacttggagaagtgaacacttacgcaggtgacctgcakaagaagctggtgccctttgccaccgagctgcatgaacgcctggccaaggactcggagaaactgaaggaggagattgggaaggagctggaggagctgaggg

SEQ ID NO: 12537 - DNA, 201 bp, Homo sapiens
gggggacgtggaaggccacttgagcttcctggagaaggacctgagggacaaggtcaactccttcttcagcaccttcaaggagaaagagagccaggacaagwctctctccctccctgagctggagcaacagcaggaacagcagcaggagcagcagcaggagcaggtgcagatgctggcccctttggagagctgagctgcccc

SEQ ID NO: 12538 - DNA, 201 bp, Homo sapiens
gtggccacagtgatgtgggactacttcagccagctgagcaacaatgccaaggaggccgtggaacatctccagaaatctgaactcacccagcaactcaatgmcctcttccaggacaaacttggagaagtgaacacttacgcaggtgacctgcagaagaagctggtgccctttgccaccgagctgcatgaacgcctggccaag

SEQ ID NO: 12539 - DNA, 201 bp, Homo sapiens
cgtgcgtggcaacctgaggggcaacaccgaggggctgcagaagtcactggcagagctgggtgggcacctggaccagcaggtggaggagttccgacgccggstggagccctacggggaaaacttcaacaaagccctggtgcagcagatggaacagctcaggcagaaactgggcccccatgcgggggacgtggaaggccactt

SEQ ID NO: 12540 - DNA, 201 bp, Homo sapiens
tggagaaggacctgagggacaaggtcaactccttcttcagcaccttcaaggagaaagagagccaggacaagactctctccctccctgagctggagcaacakcaggaacagcagcaggagcagcagcaggagcaggtgcagatgctggcccctttggagagctgagctgcccctggtgcactggccccaccctcgtggacac

SEQ ID NO: 12541 - DNA, 201 bp, Homo sapiens
gcaacaatgccaaggaggccgtggaacatctccagaaatctgaactcacccagcaactcaatgccctcttccaggacaaacttggagaagtgaacacttaygcaggtgacctgcagaagaagctggtgccctttgccaccgagctgcatgaacgcctggccaaggactcggagaaactgaaggaggagattgggaaggagc

SEQ ID NO: 12542 - DNA, 201 bp, Homo sapiens
gcaagcagctcaggatgttcctgaaggccgtggtcctgaccctggccctggtggctgtcgccggagccagggctgaggtcagtgctgaccaggtggccacrgtgatgtgggactacttcagccagctgagcaacaatgccaaggaggccgtggaacatctccagaaatctgaactcacccagcaactcaatgccctcttcc

SEQ ID NO: 12543 - DNA, 201 bp, Homo sapiens
tctgaactcacccagcaactcaatgccctcttccaggacaaacttggagaagtgaacacttacgcaggtgacctgcagaagaagctggtgccctttgccaycgagctgcatgaacgcctggccaaggactcggagaaactgaaggaggagattgggaaggagctggaggagctgagggcccggctgctgccccatgccaat

SEQ ID NO: 12544 - DNA, 201 bp, Homo sapiens
caatgccaaggaggccgtggaacatctccagaaatctgaactcacccagcaactcaatgccctcttccaggacaaacttggagaagtgaacacttacgcargtgacctgcagaagaagctggtgccctttgccaccgagctgcatgaacgcctggccaaggactcggagaaactgaaggaggagattgggaaggagctgga

SEQ ID NO: 12545 - DNA, 201 bp, Homo sapiens
tccgacgccgggtggagccctacggggaaaacttcaacaaagccctggtgcagcagatggaacagctcaggcagaaactgggcccccatgcgggggacgtkgaaggccacttgagcttcctggagaaggacctgagggacaaggtcaactccttcttcagcaccttcaaggagaaagagagccaggacaagactctctccc

SEQ ID NO: 12546 - DNA, 201 bp, Homo sapiens
atgccaaggaggccgtggaacatctccagaaatctgaactcacccagcaactcaatgccctcttccaggacaaacttggagaagtgaacacttacgcaggygacctgcagaagaagctggtgccctttgccaccgagctgcatgaacgcctggccaaggactcggagaaactgaaggaggagattgggaaggagctggagg

SEQ ID NO: 12547 - DNA, 116 bp, Homo sapiens
agttcccactgcagcrcaggtgagctctcctgaggacctctctgtcagctcccctgattgtagggaggatccagtgtggcaagaaactcctccagcccagcaagcagctcaggatg

SEQ ID NO: 12548 - DNA, 201 bp, Homo sapiens
tgagggacaaggtcaactccttcttcagcaccttcaaggagaaagagagccaggacaagactctctccctccctgagctggagcaacagcaggaacagcakcaggagcagcagcaggagcaggtgcagatgctggcccctttggagagctgagctgcccctggtgcactggccccaccctcgtggacacctgccctgccct

SEQ ID NO: 12549 - DNA, 201 bp, Homo sapiens
cctgcagaagaagctggtgccctttgccaccgagctgcatgaacgcctggccaaggactcggagaaactgaaggaggagattgggaaggagctggaggagytgagggcccggctgctgccccatgccaatgaggtgagccagaagatcggggacaacctgcgagagcttcagcagcgcctggagccctacgcggaccagct

SEQ ID NO: 12550 - DNA, 201 bp, Homo sapiens
ctgccccatgccaatgaggtgagccagaagatcggggacaacctgcgagagcttcagcagcgcctggagccctacgcggaccagctgcgcacccaggtcarcacgcaggccgagcagctgcggcgccagctgaccccctacgcacagcgcatggagagagtgctgcgggagaacgccgacagcctgcaggcctcgctgagg

SEQ ID NO: 12551 - DNA, 201 bp, Homo sapiens
caggagaagctcaaccaccagcttgagggcctgaccttccagatgaagaagaacgccgaggagctcaaggccaggatctcggccagtgccgaggagctgcrgcagaggctggcgcccttggccgaggacgtgcgtggcaacctgaggggcaacaccgaggggctgcagaagtcactggcagagctgggtgggcacctggac

SEQ ID NO: 12552 - DNA, 201 bp, Homo sapiens
ctcaggacacgcaggagaagctcaaccaccagcttgagggcctgaccttccagatgaagaagaacgccgaggagctcaaggccaggatctcggccagtgcygaggagctgcggcagaggctggcgcccttggccgaggacgtgcgtggcaacctgaggggcaacaccgaggggctgcagaagtcactggcagagctgggtg

SEQ ID NO: 12553 - DNA, 201 bp, Homo sapiens
ccgaggagctcaaggccaggatctcggccagtgccgaggagctgcggcagaggctggcgcccttggccgaggacgtgcgtggcaacctgaggggcaacacygaggggctgcagaagtcactggcagagctgggtgggcacctggaccagcaggtggaggagttccgacgccgggtggagccctacggggaaaacttcaaca

SEQ ID NO: 12554 - DNA, 201 bp, Homo sapiens
tgcggcagaggctggcgcccttggccgaggacgtgcgtggcaacctgaggggcaacaccgaggggctgcagaagtcactggcagagctgggtgggcacctrgaccagcaggtggaggagttccgacgccgggtggagccctacggggaaaacttcaacaaagccctggtgcagcagatggaacagctcaggcagaaactgg

SEQ ID NO: 12555 - DNA, 201 bp, Homo sapiens
ccaatgaggtgagccagaagatcggggacaacctgcgagagcttcagcagcgcctggagccctacgcggaccagctgcgcacccaggtcaacacgcaggcygagcagctgcggcgccagctgaccccctacgcacagcgcatggagagagtgctgcgggagaacgccgacagcctgcaggcctcgctgaggccccacgccg

SEQ ID NO: 12556 - DNA, 163 bp, Homo sapiens
tgcccctggtgcactggccccaccctcgtggacacctgccctgccctgccacctgtctgtctgtctgtcccaaagaagttctggtatgaacttgaggacayatgtccagtgggaggtgagaccacctctcaatattcaataaagctgctgagaatctagcctc

SEQ ID NO: 12557 - DNA, 201 bp, Homo sapiens
cctgcgagagcttcagcagcgcctggagccctacgcggaccagctgcgcacccaggtcaacacgcaggccgagcagctgcggcgccagctgaccccctackcacagcgcatggagagagtgctgcgggagaacgccgacagcctgcaggcctcgctgaggccccacgccgacgagctcaaggccaagatcgaccagaacgt

SEQ ID NO: 12558 - DNA, 201 bp, Homo sapiens
aagaagaacgccgaggagctcaaggccaggatctcggccagtgccgaggagctgcggcagaggctggcgcccttggccgaggacgtgcgtggcaacctgargggcaacaccgaggggctgcagaagtcactggcagagctgggtgggcacctggaccagcaggtggaggagttccgacgccgggtggagccctacggggaa

SEQ ID NO: 12559 - DNA, 201 bp, Homo sapiens
tgcagccccgggtactccttgttgttgccctcctggcgctcctggcctctgcccgagcttcagaggccgaggatgcctcccttctcagcttcatgcagggytacatgaagcacgccaccaagaccgccaaggatgcactgagcagcgtgcaggagtcccaggtggcccagcaggccaggggctgggtgaccgatggcttca

SEQ ID NO: 12560 - DNA, 167 bp, Homo sapiens
ggctgcagggctggcgggacagcagcgtggactcagtctcctagggatttcccaactctcccgcccrcttgctgcatctggacaccctgcctcaggccctcatctccactggtcagcaggtgacctttgcccagcgccctgggtcctcagtgcctgctgccctggag

SEQ ID NO: 12561 - DNA, 201 bp, Homo sapiens
gtcagaccaacttcagccgtggctgcctgagacctcaataccccaagtccacctgcctatccatcctgccagctccttgggtcctgcaatctccagggctkcccctgtaggttgcttaaaagggacagtattctcagtgctctcctaccccacctcatgcctggcccccctccaggcatgctggcctcccaataaagctgg

SEQ ID NO: 12562 - DNA, 201 bp, Homo sapiens
ggatgcactgagcagcgtgcaggagtcccaggtggcccagcaggccaggggctgggtgaccgatggcttcagttccctgaaagactactggagcaccgttraggacaagttctctgagttctgggatttggaccctgaggtcagaccaacttcagccgtggctgcctgagacctcaataccccaagtccacctgcctatcc

SEQ ID NO: 12563 - DNA, 201 bp, Homo sapiens
gggctgggtgaccgatggcttcagttccctgaaagactactggagcaccgttaaggacaagttctctgagttctgggatttggaccctgaggtcagaccarcttcagccgtggctgcctgagacctcaataccccaagtccacctgcctatccatcctgccagctccttgggtcctgcaatctccagggcttcccctgtag

SEQ ID NO: 12564 - DNA, 201 bp, Homo sapiens
gttctctgagttctgggatttggaccctgaggtcagaccaacttcagccgtggctgcctgagacctcaataccccaagtccacctgcctatccatcctgcsagctccttgggtcctgcaatctccagggcttcccctgtaggttgcttaaaagggacagtattctcagtgctctcctaccccacctcatgcctggcccccc

SEQ ID NO: 12565 - DNA, 201 bp, Homo sapiens; identical to SEQ ID NO: 12559

SEQ ID NO: 12566 - DNA, 201 bp, Homo sapiens; identical to SEQ ID NO: 12561

SEQ ID NO: 12567 - DNA, 201 bp, Homo sapiens; identical to SEQ ID NO: 12562

SEQ ID NO: 12568 - DNA, 201 bp, Homo sapiens; identical to SEQ ID NO: 12563

SEQ ID NO: 12569 - DNA, 201 bp, Homo sapiens; identical to SEQ ID NO: 12564

SEQ ID NO: 12570 - DNA, 201 bp, Homo sapiens
caaccttggcggggatcctggacatcaacttcctcatcaacaagatgcaggaagatccagcttccaagtgccactgcagtgctaatgtgaccagttgtctmtgtttgggcattccctctgacaactgcaccagaccatgcttcagtgagagactgtctcagatgaccaataccaccatgcaaacaagatacccactgattt

SEQ ID NO: 12571 - DNA, 201 bp, Homo sapiens
agatacccactgattttcagtcgggtgaaaaaatcagttgaagtactaaagaacaacaagtgtccatatttttcctgtgaacagccatgcaaccaaaccayggcaggcaacgcgctgacatttctgaagagtcttctggaaattttccagaaagaaaagatgagagggatgagaggcaagatatgaagatgaaatattatt

SEQ ID NO: 12572 - DNA, 201 bp, Homo sapiens
agtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccc

SEQ ID NO: 12573 - DNA, 201 bp, Homo sapiens
ggttgcctatggtgggcactaggaatgaggtcccctgcctcgatgcgggtcctaggagaaaaagtcctacttttctgggtccccaggtgcagcacctcccrgagactgtttctcccatggcctcctgagtgatgggccctgcctccctgtgcctcatcctcaggctggttggagcagagggtgggcaggagccccagcaca

SEQ ID NO: 12574 - DNA, 201 bp, Homo sapiens
ccgcccagcataccgcaaggtgttcctgcatgaagccaccgtgcgcctgatggcaggagccagccccacccgcacccaccagctgctggaacacagcctgmggcggcgcaccacgcagagcaccaagcacggagaggtggatgcctggcccggccagcgagagcgggccaccgccatcctgctggcctgccgccacctgcc

SEQ ID NO: 12575 - DNA, 201 bp, Homo sapiens
tatcttatttaattgtcctgttccttcccactccccgcctcctaggatgttagcccaagctcagggtaggcccagggggctgggagaaatgaagccacccrtggggactggggaccaggggccttcagcatggcttctaggttccctcctccccctaccccatctcctacctccacagtacagactgtccccaacttaaca

SEQ ID NO: 12576 - DNA, 201 bp, Homo sapiens
cattcgagtcaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagaggagatt

SEQ ID NO: 12577 - DNA, 201 bp, Homo sapiens
ccattgccgcctcctgaccaccaggctcagcccacccctccacctctctctcgatttctctctctccccctcagcatcttcccgctgagagtggtggggargagccttgtcttcttagctgtcacctgccgaggcttctgggccactcaggccagtgcacccctgggcagagccccttaaagctgctgtcactagatgccc

SEQ ID NO: 12578 - DNA, 201 bp, Homo sapiens
gttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactct

SEQ ID NO: 12579 - DNA, 201 bp, Homo sapiens
ctgagcctgctcattgtttttccctttattacacaggacagccaggggaggaggggggcccagccctgggaggctggtgggaggcagggggcaggcctgcrgatgcatgaaataatgttggcattattttttaattttttaaaaaataaatggtatcttatttaattgtcctgttccttcccactccccgcctcctaggat

SEQ ID NO: 12580 - DNA, 201 bp, Homo sapiens
ttttgcagctgctgccggcaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccggcgggccacgccagccactgaggcaggctttga

SEQ ID NO: 12581 - DNA, 201 bp, Homo sapiens
gccagcagatgattgttaagctgggtggtggcactgccattgccgcctcctgaccaccaggctcagcccacccctccacctctctctcgatttctctctcyccccctcagcatcttcccgctgagagtggtggggaagagccttgtcttcttagctgtcacctgccgaggcttctgggccactcaggccagtgcacccctg

SEQ ID NO: 12582 - DNA, 201 bp, Homo sapiens
ccagtgatccggccacactcgcgctcctcggtcaccttctggaggcaccggaaacaggcagatctggatctcgccagaggagattttgcagctgctgccgscaacctacaaacctgcctggcagttttgggccgggcactgcccacctcccgcctggacctggcctgcagcctctcctggaacgtgatccgctacagcctg

SEQ ID NO: 12583 - DNA, 201 bp, Homo sapiens
aacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacat

SEQ ID NO: 12584 - DNA, 201 bp, Homo sapiens
cctactccattgactctgagccaggaagccctctattggatgatgcaaaggtcaaagatgagccagactctcctcctgtggcgctgggcatggtagaccgstcacggattcttctgtgtgtcctcaccttcctgtgcctctcctttaaccccctgacttccctgctgcagtggggaggggcccacgactctgaccagcacc

SEQ ID NO: 12585 - DNA, 201 bp, Homo sapiens
aggaagaagagagctgtgaattctccagtgctctggagtacttgaaattacttcattcttttgtggactctgtgggggttatgagccccccactctccagsagctccgtgctcaagtccgccctgggtccagacatcatctgtcggtggtggacgtctgcaatcactgtggccatcagctggctccagggagacgatgcag

SEQ ID NO: 12586 - DNA, 201 bp, Homo sapiens
tatatatttaaacctaattaattcttgagctgaaaataaataaaccaggatggcagggaccaacccctaatccctccccagcggcaagcccctcttttcaragtgggcagagggttgcctatggtgggcactaggaatgaggtcccctgcctcgatgcgggtcctaggagaaaaagtcctacttttctgggtccccaggtg

SEQ ID NO: 12587 - DNA, 201 bp, Homo sapiens
tggtccagcctcagatcatcaagacagattcccttgttttgaccacactgaagacagatggcagccctgttatggctgcggtccagaacccggccctcacygccctcaccacccctatccagacggctgcccttcaagtaccaaccctggtgggcagcagtgggaccattctgaccacaatgcctgtaatgatggggcaag

SEQ ID NO: 12588 - DNA, 201 bp, Homo sapiens
tcatggggagccagtgatccggccacactcgcgctcctcggtcaccttctggaggcaccggaaacaggcagatctggatctcgccagaggagattttgcarctgctgccggcaacctacaaacctgcctggcagttttgggccgggcactgcccacctcccgcctggacctggcctgcagcctctcctggaacgtgatccg

SEQ ID NO: 12589 - DNA, 201 bp, Homo sapiens
atgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcag

SEQ ID NO: 12590 - DNA, 201 bp, Homo sapiens
cgcctggacctggcctgcagcctctcctggaacgtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatc

SEQ ID NO: 12591 - DNA, 201 bp, Homo sapiens
agcagcaggtgcagacagtacaggcccagcgggtgctgacacaaacggccaatggcacgctgcagacccttgccccggctacggtgcagacagttgctgcrccacaggtgcagcaggtcccggtcctggtccagcctcagatcatcaagacagattcccttgttttgaccacactgaagacagatggcagccctgttatgg

SEQ ID NO: 12592 - DNA, 174 bp, Homo sapiens
cggcgcccgggcgcaacgcaaacatggcggcgggtggcacccgtcggtgaggcggtgccgggcgggggttgtcsggtgtcatgggcggtggcgacggcaccgcccccgcgtctccctgagcgggacggcagggggggcttctgcgctgagccgggcgatggacgacagcggcga

SEQ ID NO: 12593 - DNA, 201 bp, Homo sapiens; identical to SEQ ID NO: 12572

SEQ ID NO: 12594 - DNA, 201 bp, Homo sapiens; identical to SEQ ID NO: 12574

SEQ ID NO: 12595 - DNA, 201 bp, Homo sapiens
ggatgcatgaaataatgttggcattattttttaattttttaaaaagatgttagcccaagctcagggtaggcccagggggctgggagaaatgaagccacccrtggggactggggaccaggggccttcagcatggcttctaggttccctcctccccctaccccatctcctacctccacagtacagactgtccccaacttaaca

SEQ ID NO: 12596 - DNA, 201 bp, Homo sapiens; identical to SEQ ID NO: 12576

SEQ ID NO: 12597 - DNA, 201 bp, Homo sapiens; identical to SEQ ID NO: 12577

SEQ ID NO: 12598 - DNA, 201 bp, Homo sapiens; identical to SEQ ID NO: 12578

SEQ ID NO: 12599 - DNA, 201 bp, Homo sapiens
ctgagcctgctcattgtttttccctttattacacaggacagccaggggaggaggggggcccagccctgggaggctggtgggaggcagggggcaggcctgcrgatgcatgaaataatgttggcattattttttaattttttaaaaagatgttagcccaagctcagggtaggcccagggggctgggagaaatgaagccaccca

SEQ ID NO: 12600 - DNA, 201 bp, Homo sapiens; identical to SEQ ID NO: 12580

SEQ ID NO: 12601 - DNA, 201 bp, Homo sapiens; identical to SEQ ID NO: 12581

SEQ ID NO: 12602 - DNA, 201 bp, Homo sapiens; identical to SEQ ID NO: 12582

SEQ ID NO: 12603 - DNA, 201 bp, Homo sapiens; identical to SEQ ID NO: 12583

SEQ ID NO: 12604 - DNA, 201 bp, Homo sapiens; identical to SEQ ID NO: 12584

SEQ ID NO: 12605 - DNA, 201 bp, Homo sapiens; identical to SEQ ID NO: 12585

SEQ ID NO: 12606 - DNA, 201 bp, Homo sapiens; identical to SEQ ID NO: 12586

SEQ ID NO: 12607 - DNA, 201 bp, Homo sapiens; identical to SEQ ID NO: 12587

SEQ ID NO: 12608 - DNA, 201 bp, Homo sapiens; identical to SEQ ID NO: 12588

SEQ ID NO: 12609 - DNA, 201 bp, Homo sapiens; identical to SEQ ID NO: 12589

SEQ ID NO: 12610 - DNA, 201 bp, Homo sapiens; identical to SEQ ID NO: 12590

SEQ ID NO: 12611 - DNA, 201 bp, Homo sapiens; identical to SEQ ID NO: 12591

SEQ ID NO: 12612 - DNA, 174 bp, Homo sapiens; identical to SEQ ID NO: 12592

SEQ ID NO: 12613 - DNA, 193 bp, Homo sapiens
ctttcccctgctaccagacacgcggtcacgtggggccatcgcgggctgccggcgcgggaagccgcgcgagaggcggccgaggggtgcgtgagycggcgccactgcttgcagtgcgcggcttgggagcccgcccctcctgcacggaggagtcggcctgccgccgcggcggcatctggaaccacaatggacactg

SEQ ID NO: 12614 - DNA, 201 bp, Homo sapiens
cacaaagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtc

SEQ ID NO: 12615 - DNA, 201 bp, Homo sapiens
acccttgcccccttctgcccagtgagtgcacttcacggcatcaaaagccccatgttctctggaaaggcggctgatgaggtccagctcagactctgtatccrtcctataaaggaagcatttcatatcaaagcatggaaaatggctggagagacagaattgtcttctttttgccattaaacctcatgtgaattacccactgat

SEQ ID NO: 12616 - DNA, 201 bp, Homo sapiens
aagcccaatctcatgcagacactggagggcactccagtgtttgtccatgctggcccgtttgccaacatcgcacatggcaattcctccatcattgcagaccrgatcgcactcaagcttgttggcccagaagggtttgtagtgacggaagcaggatttggagcagacattggaatggaaaagttttttaacatcaaatgccgg

SEQ ID NO: 12617 - DNA, 201 bp, Homo sapiens
agcatcaatgctgggagacttgctagaggtgacctcaatgactgtttcattccttgtacgcctaagggatgcttggaactcatcaaagagacaggggtgcygattgccggaaggcatgctgtggtggttgggcgcagtaaaatagttggggccccgatgcatgacttgcttctgtggaacaatgccacagtgaccacctgc

SEQ ID NO: 12618 - DNA, 201 bp, Homo sapiens
gccagcgttggggctggttttctgtaccccttagtaggaacgatgagcacaatgcctggactccccacccggccctgtttttatgatattgatttggaccytgaaacagaacaggtgaatggattattctaaacagacttccctgaggggagaggggatagtaatgagagttggcaataaccaatgaattgaaatatttat

SEQ ID NO: 12619 - DNA, 201 bp, Homo sapiens
gcttgtcacaggttgacagtgtaggggagaaaactgctgtccaataaactacagaggaaactacaggagagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 12620 - DNA, 201 bp, Homo sapiens
ccatccatcttcaagaagctactttgaaagtctggccagtgtctattcaggcccactgggagttaggaagtataagtaagccaagagaagtcagcccctgyccagaagatctgaaactaatagtaggagtttccccagaagtcattttcagccttaattctcatcatgtataaattaacataaatcatgcatgtctgttta

SEQ ID NO: 12621 - DNA, 201 bp, Homo sapiens
ctacctttagattcagagaattccattaacactgaagaagtgatcaatgctattgcacccgagaaggatgtggatggattgactagcatcaatgctgggaracttgctagaggtgacctcaatgactgtttcattccttgtacgcctaagggatgcttggaactcatcaaagagacaggggtgccgattgccggaaggcat

SEQ ID NO: 12622 - DNA, 201 bp, Homo sapiens
tgtctattcaggcccactgggagttaggaagtataagtaagccaagagaagtcagcccctgcccagaagatctgaaactaatagtaggagtttccccagamgtcattttcagccttaattctcatcatgtataaattaacataaatcatgcatgtctgtttactttagtgacgttccacagaataaaaggaaacaagtttg

SEQ ID NO: 12623 - DNA, 201 bp, Homo sapiens
gacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaagctcccagttgaggataaaatcag

SEQ ID NO: 12624 - DNA, 201 bp, Homo sapiens
gaggccaaagagagggcgagcttcatcactcctgttcctggcggcgtagggcccatgacagttgcaatgctcatgcagagcacagtagagagtgccaagcrtttcctggagaaatttaagccaggaaagtggatgattcagtataacaaccttaacctcaagacacctgttccaagtgacattgatatatcacgatcttgt

SEQ ID NO: 12625 - DNA, 113 bp, Homo sapiens
agtgtgatccccyggccagtccctaagcacgtgggttgggttgtcctgcttggctgcggagggagtggaacctcgatattggtggtgtccatcgtgggcagcggactaataaa

SEQ ID NO: 12626 - DNA, 201 bp, Homo sapiens
ctggagctggttgaaaaaggcttcagtaacttgaagaaacaaattgaaaatgccagaatgtttggaattccagtagtagtggccgtgaatgcattcaagayggatacagagtctgagctggacctcatcagccgcctttccagagaacatggggcttttgatgccgtgaagtgcactcactgggcagaagggggcaagggt

SEQ ID NO: 12627 - DNA, 201 bp, Homo sapiens; identical to SEQ ID NO: 12616

SEQ ID NO: 12628 - DNA, 201 bp, Homo sapiens; identical to SEQ ID NO: 12617

SEQ ID NO: 12629 - DNA, 201 bp, Homo sapiens
gccagcgttggggctggttttctgtaccccttagtaggaacgatgagcacaatgcctggactccccacccggccctgtttttatgatattgatttggaccytgaaacagaacaggtgaatggattattctaaacagatcaccatccatcttcaagaagctactttgaaagtctggccagtgtctattcaggcccactggga

SEQ ID NO: 12630 - DNA, 201 bp, Homo sapiens
cacccggccctgtttttatgatattgatttggaccctgaaacagaacaggtgaatggattattctaaacagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 12631 - DNA, 201 bp, Homo sapiens; identical to SEQ ID NO: 12620

SEQ ID NO: 12632 - DNA, 201 bp, Homo sapiens; identical to SEQ ID NO: 12621

SEQ ID NO: 12633 - DNA, 201 bp, Homo sapiens; identical to SEQ ID NO: 12622

SEQ ID NO: 12634 - DNA, 201 bp, Homo sapiens; identical to SEQ ID NO: 12623

SEQ ID NO: 12635 - DNA, 201 bp, Homo sapiens; identical to SEQ ID NO: 12624

SEQ ID NO: 12636 - DNA, 113 bp, Homo sapiens; identical to SEQ ID NO: 12625

SEQ ID NO: 12637 - DNA, 201 bp, Homo sapiens; identical to SEQ ID NO: 12626

SEQ ID NO: 12638 - DNA, 201 bp, Homo sapiens
cccagagacagttagttatttgacctaacaacggaaaacggtcaccccaggaagagtttggtgcctctgtccaggccggttccagacctgtcttgagacthtctccgtatttaagtcaacattcattcggttacacagaagttactttttaatttttaaggaggaaccagtgatgattggtgacaaatctctcacaattaa

SEQ ID NO: 12639 - DNA, 201 bp, Homo sapiens
ccacgcgccgtcctccgaggaactgggcgcttgcagtgcgttgcacaccctcacctcccacccactgattattaataaagtcttttcttttacctgccaaygcttagtttctttgcccaaagggagtttcggctggacaggtgctagcgtggggagctgctgtagggtcccagagacagttagttatttgacctaacaacg

SEQ ID NO: 12640 - DNA, 111 bp, Homo sapiens
ctttcgtttaagaagctataacttaaaccatcttcagaaacaagatctgtcacccgtagagcttagagtccaaatagacacctatgaggcgagcacaaggrgcggtgtgag

SEQ ID NO: 12641 - DNA, 201 bp, Homo sapiens
ggtgcctctgtccaggccggttccagacctgtcttgagactctctccgtatttaagtcaacattcattcggttacacagaagttactttttaatttttaargaggaaccagtgatgattggtgacaaatctctcacaattaaaaatgggtggaagggccaaatataaaaacattttgcagtattttattctttcgtttaag

SEQ ID NO: 12642 - DNA, 201 bp, Homo sapiens
agcggcttttcttctggatgcaggaacccaagacagaccaggatgaggagcattgccggaaagtcaacgagtatctgaacaaccccccgatgcctggggcrctgggggccagcggaagcagcggccacgaactctctgcgctaggcggtgagggtggcctgcagagcctgctgggaaacatgagccacagccagctcatgc

SEQ ID NO: 12643 - DNA, 201 bp, Homo sapiens
tgggtgggctgggggccctgactggacctggcctggccagcttactggggagcagtgggcctccagggagcagctcctcctccagctcccggagccagtckgcagcggtcaccccgtcatccaccacctcttccacccgtgccaccccagccccttctgctccagcagctgcctcagcaactagcccgagccccgcgccca

SEQ ID NO: 12644 - DNA, 201 bp, Homo sapiens
gccacgaactctctgcgctaggcggtgagggtggcctgcagagcctgctgggaaacatgagccacagccagctcatgcagctcatcggaccagccggcctyggaggactgggtgggctgggggccctgactggacctggcctggccagcttactggggagcagtgggcctccagggagcagctcctcctccagctcccgga

SEQ ID NO: 12645 - DNA, 201 bp, Homo sapiens
gaggctgtggaggccgccaacaagggcgatgtggaagcgtttgccaaagccatgcagaacaacgccaagcccgagcagaaagagggcgacacgaaggacamgaaggacgaagaggaggacatgagcctggactgagccacgcgccgtcctccgaggaactgggcgcttgcagtgcgttgcacaccctcacctcccacccac

SEQ ID NO: 12646 - DNA, 201 bp, Homo sapiens
agaacaacgccaagcccgagcagaaagagggcgacacgaaggacaagaaggacgaagaggaggacatgagcctggactgagccacgcgccgtcctccgagsaactgggcgcttgcagtgcgttgcacaccctcacctcccacccactgattattaataaagtcttttcttttacctgccaacgcttagtttctttgcccaa

SEQ ID NO: 12647 - DNA, 201 bp, Homo sapiens
ccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaagtggacctggccagtg

SEQ ID NO: 12648 - DNA, 201 bp, Homo sapiens
agctgctgtagggtcccagagacagttagttatttgacctaacaacggaaaacggtcaccccaggaagagtttggtgcctctgtccaggccggttccagayctgtcttgagactctctccgtatttaagtcaacattcattcggttacacagaagttactttttaatttttaaggaggaaccagtgatgattggtgacaaa

SEQ ID NO: 12649 - DNA, 201 bp, Homo sapiens
attacagcatcaaggatatcagcatcggaggccgctgtgtctgccacggccacgcggatgcctgcgatgccaaagaccccacggacccgttcaggctgcartgcacctgccagcacaacacctgcgggggcacctgcgaccgctgctgccccggcttcaatcagcagccgtggaagcctgcgactgccaacagtgccaacg

SEQ ID NO: 12650 - DNA, 201 bp, Homo sapiens
ggagcgcctcgccgccagcctggacggggctcggaccccactgctgcagaggatgcagaccttctccccggcgggcagcaagctgcgtctagtggaggccrccgaggcccacgcacagcagctgggccagctggcactcaatctgtccagcatcatcctggacgtcaaccaggaccgcctcacccagagggccatcgaggc

SEQ ID NO: 12651 - DNA, 201 bp, Homo sapiens
ccctggctctggcgtctgtgtggactgccagcacaacaccgaaggggcccactgtgagcgctgccaggctggcttcgtgagcagcagggacgaccccagcrccccctgtgtcagctgcccctgccccctctcagtgccttccaacaacttcgccgagggctgtgtcctgcgaggcggccgcacccagtgcctctgcaaacc

SEQ ID NO: 12652 - DNA, 201 bp, Homo sapiens
tgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccggtgcgactgtaccccatgtgggacagaggcc

SEQ ID NO: 12653 - DNA, 201 bp, Homo sapiens
cggagctcgtcctacacccgccaggagttcgtggatatggagggatgggtgctgctgagcactgaccggcaggtggtgccccacgagcggcagccagggayggagatgctccgtgcagacctgcggcacgtgcctgaggctgtgcccgaggctttccccgagctgtactggcaggccccaccctcctacctgggggaccgg

SEQ ID NO: 12654 - DNA, 201 bp, Homo sapiens
gggagcggtgtgacgtgtgtgccgagggcttcacgggcttcccaagctgctacccgacgccctcgtcctccaatgacaccagggagcaggtgctgccagcyggccagattgtgaattgtgactgcagcgcggcagggacccagggcaacgcctgccggaaggacccaagggtgggacgctgtctgtgcaaacccaacttcc

SEQ ID NO: 12655 - DNA, 201 bp, Homo sapiens
cagtgttccagccctggagtggccgatgaccgctgtgaccctgacacaggccagtgcaggtgccgagtgggcttcgagggggccacatgtgatcgctgtgyccccggctactttcacttccctctctgccagttgtgtggctgcagccctgcaggaaccttgcccgagggctgcgatgaggccggccgctgcctatgccag

SEQ ID NO: 12656 - DNA, 201 bp, Homo sapiens
ccatggccacggcttccttcgcctggcgctctcgaacgtggcaccgctcactggcaacgtctactccggcttcggcttccacagcgcccaggacagtgccytgctctactaccgggcgtccccggatgggctatgccaggtgtccctgcagcagggccgtgtgagcctacagctcctgaggactgaagtgaaaactcaagc

SEQ ID NO: 12657 - DNA, 201 bp, Homo sapiens
gccgctgccgccccggctacacaggcactgcctgccaggaatgcagccccggctttcacggcttccccagctgtgtcccctgccactgctctgctgaaggstccctgcacgcagcctgtgacccccggagtgggcagtgcagctgccggccccgtgtgacggggctgcggtgtgacacgtgtgtgcccggtgcctacaact

SEQ ID NO: 12658 - DNA, 201 bp, Homo sapiens
ctggttatgcaggtgcctcctgcgagcggtgtgcgcccggattctttgggaacccactggtgctgggcagctcctgccagccatgcgactgcagcggcaayggtgaccccaacttgctcttcagcgactgcgaccccctgacgggcgcctgccgtggctgcctgcgccacaccactgggccccgctgcgagatctgtgccc

SEQ ID NO: 12659 - DNA, 201 bp, Homo sapiens
tgcacccgctgcttctgctttggggccacggagcgctgccggagctcgtcctacacccgccaggagttcgtggatatggagggatgggtgctgctgagcaytgaccggcaggtggtgccccacgagcggcagccagggacggagatgctccgtgcagacctgcggcacgtgcctgaggctgtgcccgaggctttccccgag

SEQ ID NO: 12660 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaaggtgactcctgtgagtcacaggcacaggttccctgtatgtgccgggctcacgtggaggggccga

SEQ ID NO: 12661 - DNA, 201 bp, Homo sapiens
gcctgtacagcaccctgtgccggggcactgcccgggatacccaggaccacctggctgtcttccacctggactcggaggccagcgtgaggctcacagccgarcaggcacgcttcttcctgcacggggtcactctggtgcccattgaggagttcagcccggagttcgtggagccccgggtcagctgcatcagcagccacggcg

SEQ ID NO: 12662 - DNA, 201 bp, Homo sapiens
cccaacccgggccagtgcaggccttcaccttccgcctcccacagagccagctccggagccccctgggcccccaccatgagacggcacagcagctggaggcygtggggacccgagaccaggcgagccaattgctggccggcaccgaggccacactgggccatgcgaagacgctgttggcggccatccgggctgtggaccgca

SEQ ID NO: 12663 - DNA, 201 bp, Homo sapiens
caattgctggccggcaccgaggccacactgggccatgcgaagacgctgttggcggccatccgggctgtggaccgcaccctgagcgagctcatgtcccagaygggccacctggggctggccaatgcctcggctccatcaggtgagcagctgctccggacactggccgaggtggagcggctgctctgggagatgcgggcccgg

SEQ ID NO: 12664 - DNA, 201 bp, Homo sapiens
ggtattattacagcatcaaggatatcagcatcggaggccgctgtgtctgccacggccacgcggatgcctgcgatgccaaagaccccacggacccgttcagrctgcagtgcacctgccagcacaacacctgcgggggcacctgcgaccgctgctgccccggcttcaatcagcagccgtggaagcctgcgactgccaacagtg

SEQ ID NO: 12665 - DNA, 201 bp, Homo sapiens
acagtcagatcagcaccaccaagcgcttcgagcaggagctgcggctcgtgtcctacagcggggtgctcttcttcctgaagcagcagagccagttcctgtgyttggccgtgcaagaaggcagcctcgtgctgttgtatgactttggggctggcctgaaaaaggccgtcccactgcagcccccaccgcccctgacctcggcca

SEQ ID NO: 12666 - DNA, 201 bp, Homo sapiens
ggacaatgatctggagctggccgacgcctactacctggggggcgtgccgcccgaccagctgcccccgagcctgcgacggctcttccccaccggaggctcastccgtggctgcgtcaaaggcatcaaggccctgggcaagtatgtggacctcaagcggctgaacacgacaggcgtgagcgccggctgcaccgccgacctgct

SEQ ID NO: 12667 - DNA, 201 bp, Homo sapiens
aagtaggtgctacaggccccacgtgtgagcccttcgggggccagtgtccctgccatgcccatgtcattggccgtgactgctcccgctgtgccaccggatastggggcttccccaactgcaggccctgtgactgcggtgcccgcctctgtgacgagctcacgggccagtgcatctgcccgccacgcaccatcccgcccgact

SEQ ID NO: 12668 - DNA, 201 bp, Homo sapiens
gggccccacctgcagcgagcctgcgagggaccactacctcccggacctgcaccacctgcgcctggagctggaggaggctgccacacctgagggtcacgccrtgcgctttggcttcaaccccctcgagttcgagaacttcagctggaggggctacgcgcagatggcacctgtccagcccaggatcgtggccaggctgaacct

SEQ ID NO: 12669 - DNA, 201 bp, Homo sapiens
ccctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaaggtgactcctgtgagtcacaggcacaggttccctgtatgtgccgggctcacgtggaggggccg

SEQ ID NO: 12670 - DNA, 201 bp, Homo sapiens
ccgccgacctgctggtggggcgcgccatgactttccatggccacggcttccttcgcctggcgctctcgaacgtggcaccgctcactggcaacgtctactcyggcttcggcttccacagcgcccaggacagtgccctgctctactaccgggcgtccccggatgggctatgccaggtgtccctgcagcagggccgtgtgagcc

SEQ ID NO: 12671 - DNA, 201 bp, Homo sapiens
cagctgaggctgagttggctgcagcacagagattgctggcccgggtgcaggagcagctgagcagcctctgggaggagaaccaggcactggccacacaaacscgcgaccggctggcccagcacgaggccggcctcatggacctgcgagaggctttgaaccgggcagtggacgccacacgggaggcccaggagctcaacagcc

SEQ ID NO: 12672 - DNA, 201 bp, Homo sapiens
accccgagggctgtacccgtgagtgtgccctggagtattggggctgcagctgcgacctcaggggcacactgggtggagttgctgagtgccagccgggcacyggccagtgcttctgcaagccccacgtgtgcggccaggcctgcgcgtcctgcaaggatggcttctttggactggatcaggctgactattttggctgccgca

SEQ ID NO: 12673 - DNA, 201 bp, Homo sapiens
gacctcaggggcacactgggtggagttgctgagtgccagccgggcaccggccagtgcttctgcaagccccacgtgtgcggccaggcctgcgcgtcctgcamggatggcttctttggactggatcaggctgactattttggctgccgcagctgccggtgtgacattggcggtgcactgggccagagctgtgaaccgaggacg

SEQ ID NO: 12674 - DNA, 201 bp, Homo sapiens
tttgtcaccaatcatcactggttcctccttaaaaattaaaaagtaacttctgtgtaaccgaatgaatgttgacttaaatacggagagagtctcaagacagrtctggaaccggcctggacagaggcaccaaactcttcctggggtgaccgttttccgttgttaggtcaaataactaactgtctctgggaccctacagcagct

SEQ ID NO: 12675 - DNA, 201 bp, Homo sapiens
gtaccccggtgcgactgtaccccatgtgggacagaggcctgcgacccccacagcgggcactgcctgtgcaaggcgggcgtgactgggcggcgctgtgaccrctgccaggagggacattttggtttcgatggctgcgggggctgccgcccgtgtgcttgtggaccggccgccgagggctccgagtgccacccccagagcgga

SEQ ID NO: 12676 - DNA, 201 bp, Homo sapiens
gtacagcaccctgtgccggggcactgcccgggatacccaggaccacctggctgtcttccacctggactcggaggccagcgtgaggctcacagccgagcagkcacgcttcttcctgcacggggtcactctggtgcccattgaggagttcagcccggagttcgtggagccccgggtcagctgcatcagcagccacggcgcctt

SEQ ID NO: 12677 - DNA, 201 bp, Homo sapiens
gtgagcccttcgggggccagtgtccctgccatgcccatgtcattggccgtgactgctcccgctgtgccaccggatactggggcttccccaactgcaggccytgtgactgcggtgcccgcctctgtgacgagctcacgggccagtgcatctgcccgccacgcaccatcccgcccgactgcctactgtgccagccccagacct

SEQ ID NO: 12678 - DNA, 201 bp, Homo sapiens
ccatccggggccagtactgtgacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtcttccacgtggcctacgtcctcatcaagtttgccaact

SEQ ID NO: 12679 - DNA, 201 bp, Homo sapiens
ggccacggtgtacagcgtggagcaggacaatgatctggagctggccgacgcctactacctggggggcgtgccgcccgaccagctgcccccgagcctgcgayggctcttccccaccggaggctcagtccgtggctgcgtcaaaggcatcaaggccctgggcaagtatgtggacctcaagcggctgaacacgacaggcgtgag

SEQ ID NO: 12680 - DNA, 201 bp, Homo sapiens
ccggaggctcagtccgtggctgcgtcaaaggcatcaaggccctgggcaagtatgtggacctcaagcggctgaacacgacaggcgtgagcgccggctgcacygccgacctgctggtggggcgcgccatgactttccatggccacggcttccttcgcctggcgctctcgaacgtggcaccgctcactggcaacgtctactccg

SEQ ID NO: 12681 - DNA, 201 bp, Homo sapiens
cctgtgactgcggtgcccgcctctgtgacgagctcacgggccagtgcatctgcccgccacgcaccatcccgcccgactgcctactgtgccagccccagacytttggctgccaccccctggtcggctgtgaggagtgtaactgctcagggcccggcatccaggagctcacagaccctacctgtgacacagacagcggccagt

SEQ ID NO: 12682 - DNA, 201 bp, Homo sapiens
cgggcctggggcctagaggactgcaggccaccgcccggaaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggcccagtctctcca

SEQ ID NO: 12683 - DNA, 201 bp, Homo sapiens
cagcagaacctgggcagcgtcaatgtgagcacgggctgtgcacccgccctgcaagcccagaccccgggcctggggcctagaggactgcaggccaccgcccrgaaggcctcccgccgcagccgtcagcccgcccggcatcctgcctgcatgctgcccccacacctcaggaccacccgagactcctaccagtttgggggttcc

SEQ ID NO: 12684 - DNA, 201 bp, Homo sapiens
gggcccgtctgcacaggctgaacgcctccatcgctgacctgcaggtactgagcgtcctggccttccctccccaacccgggccagtgcaggccttcaccttycgcctcccacagagccagctccggagccccctgggcccccaccatgagacggcacagcagctggaggccgtggggacccgagaccaggcgagccaattgc

SEQ ID NO: 12685 - DNA, 201 bp, Homo sapiens
atgtggacgtccagcttcaagtggcagtgccacagccaggccgctatgccctagtggtggagtacgccaatgaggatgcccgccaggaggtgggcgtggcygtgcacaccccacagcgggccccccagcaggggctgctctccctgcacccctgcctgtacagcaccctgtgccggggcactgcccgggatacccaggacc

SEQ ID NO: 12686 - DNA, 201 bp, Homo sapiens
gccgcacctaccagccctggcagttctttgcctcctccaagagggactgtctggagcggttcgggccacagacgctggagcgcatcacacgggacgacgcrgccatctgcaccaccgagtactcacgcatcggccacactggcgtcaccgcatactgcccacagatcgtggtgtccctggtgaacggacgtccgggcgcca

SEQ ID NO: 12687 - DNA, 201 bp, Homo sapiens
cacggagcgctgccggagctcgtcctacacccgccaggagttcgtggatatggagggatgggtgctgctgagcactgaccggcaggtggtgccccacgagyggcagccagggacggagatgctccgtgcagacctgcggcacgtgcctgaggctgtgcccgaggctttccccgagctgtactggcaggccccaccctccta

SEQ ID NO: 12688 - DNA, 201 bp, Homo sapiens
ccatggacactcagaccgctgcctccctggctctggcgtctgtgtggactgccagcacaacaccgaaggggcccactgtgagcgctgccaggctggcttcrtgagcagcagggacgaccccagcaccccctgtgtcagctgcccctgccccctctcagtgccttccaacaacttcgccgagggctgtgtcctgcgaggcgg

SEQ ID NO: 12689 - DNA, 201 bp, Homo sapiens
aatgccaccctgcaggccactctgcatgcggctagggacaccctggccagcgtcttcagattgctgcacagcctggaccaggctaaggaggagctggagcrcctcgccgccagcctggacggggctcggaccccactgctgcagaggatgcagaccttctccccggcgggcagcaagctgcgtctagtggaggccgccgag

SEQ ID NO: 12690 - DNA, 201 bp, Homo sapiens
ctctgcatgcggctagggacaccctggccagcgtcttcagattgctgcacagcctggaccaggctaaggaggagctggagcgcctcgccgccagcctggayggggctcggaccccactgctgcagaggatgcagaccttctccccggcgggcagcaagctgcgtctagtggaggccgccgaggcccacgcacagcagctgg

SEQ ID NO: 12691 - DNA, 201 bp, Homo sapiens
gtggaggtccacggggcagtgggggccagtggctgcccagccgcctaggacacagccaaccccggcccctggtcaggcccctgcagctgcctcacaccgcyccttgtgctcgcctcataggtgtctatttggactctaagctctacgggtgacagatcttgtttctgaagatggtttaagttatagcttcttaaacgaaag

SEQ ID NO: 12692 - DNA, 201 bp, Homo sapiens
cttaaacgaaagaataaaatactgcaaaatgtttttatatttggcccttccacccatttttaattgtgagagatttgtcaccaatcatcactggttcctcyttaaaaattaaaaagtaacttctgtgtaaccgaatgaatgttgacttaaatacggagagagtctcaagacaggtctggaaccggcctggacagaggcacc

SEQ ID NO: 12693 - DNA, 201 bp, Homo sapiens
ttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggccaccgtggtcttcaccacc

SEQ ID NO: 12694 - DNA, 201 bp, Homo sapiens
caggtactgagcgtcctggccttccctccccaacccgggccagtgcaggccttcaccttccgcctcccacagagccagctccggagccccctgggcccccrccatgagacggcacagcagctggaggccgtggggacccgagaccaggcgagccaattgctggccggcaccgaggccacactgggccatgcgaagacgctg

SEQ ID NO: 12695 - DNA, 201 bp, Homo sapiens
gtgggacagaggcctgcgacccccacagcgggcactgcctgtgcaaggcgggcgtgactgggcggcgctgtgaccgctgccaggagggacattttggtttygatggctgcgggggctgccgcccgtgtgcttgtggaccggccgccgagggctccgagtgccacccccagagcggacagtgccactgccgaccagggacca

SEQ ID NO: 12696 - DNA, 201 bp, Homo sapiens
ttaattgtgagagatttgtcaccaatcatcactggttcctccttaaaaattaaaaagtaacttctgtgtaaccgaatgaatgttgacttaaatacggagadagtctcaagacaggtctggaaccggcctggacagaggcaccaaactcttcctggggtgaccgttttccgttgttaggtcaaataactaactgtctctggg

SEQ ID NO: 12697 - DNA, 201 bp, Homo sapiens
gcccgccacgcaccatcccgcccgactgcctactgtgccagccccagacctttggctgccaccccctggtcggctgtgaggagtgtaactgctcagggccyggcatccaggagctcacagaccctacctgtgacacagacagcggccagtgcaagtgcagacccaacgtgactgggcgccgctgtgatacctgctctccgg

SEQ ID NO: 12698 - DNA, 201 bp, Homo sapiens
cactggatgctgccaaccccaaaggttgcacccgctgcttctgctttggggccacggagcgctgccggagctcgtcctacacccgccaggagttcgtggayatggagggatgggtgctgctgagcactgaccggcaggtggtgccccacgagcggcagccagggacggagatgctccgtgcagacctgcggcacgtgcctg

SEQ ID NO: 12699 - DNA, 201 bp, Homo sapiens
agacccaacgtgactgggcgccgctgtgatacctgctctccgggcttccatggctacccccgctgccgcccctgtgactgtcacgaggcgggcactgcgcytggcgtgtgtgaccccctcacagggcagtgctactgtaaggagaacgtgcagggccccaaatgtgaccagtgcagccttgggaccttctcactggatgct

SEQ ID NO: 12700 - DNA, 201 bp, Homo sapiens
gagtgtaactgctcagggcccggcatccaggagctcacagaccctacctgtgacacagacagcggccagtgcaagtgcagacccaacgtgactgggcgccrctgtgatacctgctctccgggcttccatggctacccccgctgccgcccctgtgactgtcacgaggcgggcactgcgcctggcgtgtgtgaccccctcaca

SEQ ID NO: 12701 - DNA, 201 bp, Homo sapiens
accggcaggtggtgccccacgagcggcagccagggacggagatgctccgtgcagacctgcggcacgtgcctgaggctgtgcccgaggctttccccgagctrtactggcaggccccaccctcctacctgggggaccgggtgtcatcctacggtgggaccctccgttatgaactgcactcagagacccagcggggagatgtct

SEQ ID NO: 12702 - DNA, 201 bp, Homo sapiens
agggatgcaccctggggagggttgcgcggggaggagggaggcctgctgggcgtaccccggtgcgactgtaccccatgtgggacagaggcctgcgacccccrcagcgggcactgcctgtgcaaggcgggcgtgactgggcggcgctgtgaccgctgccaggagggacattttggtttcgatggctgcgggggctgccgcccg

SEQ ID NO: 12703 - DNA, 201 bp, Homo sapiens
tcatcaagtttgccaactcaccccggccggacctctgggtgctggagcggtccatggacttcggccgcacctaccagccctggcagttctttgcctcctcyaagagggactgtctggagcggttcgggccacagacgctggagcgcatcacacgggacgacgcggccatctgcaccaccgagtactcacgcatcggccaca

SEQ ID NO: 12704 - DNA, 201 bp, Homo sapiens
actcgcaacactgtgtcccgcgaggagctcatgatggtgctggccagcctggagcagctgcagatccgtgccctcttctcacagatctcctcggctgtctycctgcgcagggtggcactggaggtggccagcccagcaggccagggggccctggccagcaatgtggagctgtgcctgtgccccgccagctaccggggggac

SEQ ID NO: 12705 - DNA, 201 bp, Homo sapiens
tgcagacccaacgtgactgggcgccgctgtgatacctgctctccgggcttccatggctacccccgctgccgcccctgtgactgtcacgaggcgggcactgygcctggcgtgtgtgaccccctcacagggcagtgctactgtaaggagaacgtgcagggccccaaatgtgaccagtgcagccttgggaccttctcactggat

SEQ ID NO: 12706 - DNA, 201 bp, Homo sapiens
aggcgggcgtgactgggcggcgctgtgaccgctgccaggagggacattttggtttcgatggctgcgggggctgccgcccgtgtgcttgtggaccggccgcygagggctccgagtgccacccccagagcggacagtgccactgccgaccagggaccatgggaccccagtgccgcgagtgtgcccctggctactgggggctcc

SEQ ID NO: 12707 - DNA, 201 bp, Homo sapiens
gcttcaaccccctcgagttcgagaacttcagctggaggggctacgcgcagatggcacctgtccagcccaggatcgtggccaggctgaacctgacctccccygaccttttctggctcgtcttccgatacgtcaaccggggggccatgagtgtgagcgggcgggtctctgtgcgagaggagggcaggtcggccgcctgtgcca

SEQ ID NO: 12708 - DNA, 201 bp, Homo sapiens
tgggacagaggcctgcgacccccacagcgggcactgcctgtgcaaggcgggcgtgactgggcggcgctgtgaccgctgccaggagggacattttggtttcratggctgcgggggctgccgcccgtgtgcttgtggaccggccgccgagggctccgagtgccacccccagagcggacagtgccactgccgaccagggaccat

SEQ ID NO: 12709 - DNA, 201 bp, Homo sapiens
gacctcccccgaccttttctggctcgtcttccgatacgtcaaccggggggccatgagtgtgagcgggcgggtctctgtgcgagaggagggcaggtcggccrcctgtgccaactgcacagcacagagtcagcccgtggccttcccacccagcacggagcctgccttcatcaccgtgccccagaggggcttcggagagccctt

SEQ ID NO: 12710 - DNA, 106 bp, Homo sapiens
cgttgttaggtcaaataactaactgtctctgggaccctacagcagctccccacgctagcacctgtccagccgaaactccctttgggcaaagaaactaagcrttggc

SEQ ID NO: 12711 - DNA, 201 bp, Homo sapiens
ccctgcagcagggccgtgtgagcctacagctcctgaggactgaagtgaaaactcaagcgggcttcgccgatggtgccccccattacgtcgccttctacagyaatgccacgggagtctggctgtatgtcgatgaccagctccagcagatgaagccccaccggggaccaccccccgagctccagccgcagcctgaggggcccc

SEQ ID NO: 12712 - DNA, 201 bp, Homo sapiens
cccccgaccttttctggctcgtcttccgatacgtcaaccggggggccatgagtgtgagcgggcgggtctctgtgcgagaggagggcaggtcggccgcctgygccaactgcacagcacagagtcagcccgtggccttcccacccagcacggagcctgccttcatcaccgtgccccagaggggcttcggagagccctttgtgc

SEQ ID NO: 12713 - DNA, 201 bp, Homo sapiens
cctgcgcctggagctggaggaggctgccacacctgagggtcacgccgtgcgctttggcttcaaccccctcgagttcgagaacttcagctggaggggctacrcgcagatggcacctgtccagcccaggatcgtggccaggctgaacctgacctcccccgaccttttctggctcgtcttccgatacgtcaaccggggggccat

SEQ ID NO: 12714 - DNA, 201 bp, Homo sapiens
ggaagcctgcgactgccaacagtgccaacgagtgccagtcctgtaactgctacggccatgccaccgactgttactacgaccctgaggtggaccggcgccgygccagccagagcctggatggcacctatcagggtgggggtgtctgtatcgactgccagcaccacaccgccggcgtcaactgtgagcgctgcctgcccggct

SEQ ID NO: 12715 - DNA, 201 bp, Homo sapiens
ctgttactacgaccctgaggtggaccggcgccgcgccagccagagcctggatggcacctatcagggtgggggtgtctgtatcgactgccagcaccacaccrccggcgtcaactgtgagcgctgcctgcccggcttctaccgctctcccaaccaccctctcgactcgccccacgtctgccgccgctgcaactgcgagtccga

SEQ ID NO: 12716 - DNA, 201 bp, Homo sapiens
ccgccggcgtcaactgtgagcgctgcctgcccggcttctaccgctctcccaaccaccctctcgactcgccccacgtctgccgccgctgcaactgcgagtcygacttcacggatggcacctgcgaggacctgacgggtcgatgctactgccggcccaacttctctggggagcggtgtgacgtgtgtgccgagggcttcacgg

SEQ ID NO: 12717 - DNA, 201 bp, Homo sapiens
cgtctactccggcttcggcttccacagcgcccaggacagtgccctgctctactaccgggcgtccccggatgggctatgccaggtgtccctgcagcagggcygtgtgagcctacagctcctgaggactgaagtgaaaactcaagcgggcttcgccgatggtgccccccattacgtcgccttctacagcaatgccacgggagt

SEQ ID NO: 12718 - DNA, 201 bp, Homo sapiens
agtgcctctgcaaacctggttatgcaggtgcctcctgcgagcggtgtgcgcccggattctttgggaacccactggtgctgggcagctcctgccagccatgygactgcagcggcaacggtgaccccaacttgctcttcagcgactgcgaccccctgacgggcgcctgccgtggctgcctgcgccacaccactgggccccgct

SEQ ID NO: 12719 - DNA, 201 bp, Homo sapiens
agatgtctttgtccccatggagagcaggccggatgtggtgctgcagggcaaccagatgagcatcacattcctggagccggcataccccacgcctggccacrttcaccgtgggcagctgcagctggtggaggggaacttccggcatacggagactcgcaacactgtgtcccgcgaggagctcatgatggtgctggccagcct

SEQ ID NO: 12720 - DNA, 201 bp, Homo sapiens
ggctgtgcccgaggctttccccgagctgtactggcaggccccaccctcctacctgggggaccgggtgtcatcctacggtgggaccctccgttatgaactgyactcagagacccagcggggagatgtctttgtccccatggagagcaggccggatgtggtgctgcagggcaaccagatgagcatcacattcctggagccggc

SEQ ID NO: 12721 - DNA, 201 bp, Homo sapiens
ggagttcgtggatatggagggatgggtgctgctgagcactgaccggcaggtggtgccccacgagcggcagccagggacggagatgctccgtgcagacctgyggcacgtgcctgaggctgtgcccgaggctttccccgagctgtactggcaggccccaccctcctacctgggggaccgggtgtcatcctacggtgggaccct

SEQ ID NO: 12722 - DNA, 201 bp, Homo sapiens
gcttccccaactgcaggccctgtgactgcggtgcccgcctctgtgacgagctcacgggccagtgcatctgcccgccacgcaccatcccgcccgactgcctrctgtgccagccccagacctttggctgccaccccctggtcggctgtgaggagtgtaactgctcagggcccggcatccaggagctcacagaccctacctgtg

SEQ ID NO: 12723 - DNA, 201 bp, Homo sapiens
agatgagcatcacattcctggagccggcataccccacgcctggccacgttcaccgtgggcagctgcagctggtggaggggaacttccggcatacggagackcgcaacactgtgtcccgcgaggagctcatgatggtgctggccagcctggagcagctgcagatccgtgccctcttctcacagatctcctcggctgtctccc

SEQ ID NO: 12724 - DNA, 201 bp, Homo sapiens
ttcacttccctctctgccagttgtgtggctgcagccctgcaggaaccttgcccgagggctgcgatgaggccggccgctgcctatgccagcctgagtttgcyggacctcattgtgaccggtgccgccctggctaccatggtttccccaactgccaagcatgcacctgcgaccctcggggagccctggaccagctctgtgggg

SEQ ID NO: 12725 - DNA, 201 bp, Homo sapiens
cgccctgctgcccggcaactgcacccgtaggcgtcgggctgggagggatgcaccctggggagggttgcgcggggaggagggaggcctgctgggcgtacccrggtgcgactgtaccccatgtgggacagaggcctgcgacccccacagcgggcactgcctgtgcaaggcgggcgtgactgggcggcgctgtgaccgctgcca

SEQ ID NO: 12726 - DNA, 201 bp, Homo sapiens
tgccttccaacaacttcgccgagggctgtgtcctgcgaggcggccgcacccagtgcctctgcaaacctggttatgcaggtgcctcctgcgagcggtgtgcrcccggattctttgggaacccactggtgctgggcagctcctgccagccatgcgactgcagcggcaacggtgaccccaacttgctcttcagcgactgcgacc

SEQ ID NO: 12727 - DNA, 201 bp, Homo sapiens
gcaaacctggttatgcaggtgcctcctgcgagcggtgtgcgcccggattctttgggaacccactggtgctgggcagctcctgccagccatgcgactgcagyggcaacggtgaccccaacttgctcttcagcgactgcgaccccctgacgggcgcctgccgtggctgcctgcgccacaccactgggccccgctgcgagatct

SEQ ID NO: 12728 - DNA, 201 bp, Homo sapiens
cgcgcggctccccgcgccccaccgaggacctttactgcaagctggtagggggccccgtggccggcggcgaccccaaccagaccatccggggccagtactgygacatctgcacggctgccaacagcaacaaggcacaccccgcgagcaatgccatcgatggcacggagcgctggtggcagagtccaccgctgtcccgcggcc

SEQ ID NO: 12729 - DNA, 201 bp, Homo sapiens
ctgtccacatggctacggctgccgcaccctggtggtgtgtgagggccaggccctgctggacgtgacccacagcgagctcactgtgaccgtgcgtgtgcccragggccggtggctctggctggattatgtactcgtggtccctgagaacgtctacagctttggctacctccgggaggagcccctggataaatcctatgactt

SEQ ID NO: 12730 - DNA, 201 bp, Homo sapiens; identical to SEQ ID NO: 12649

SEQ ID NO: 12731 - DNA, 201 bp, Homo sapiens; identical to SEQ ID NO: 12650

SEQ ID NO: 12732 - DNA, 201 bp, Homo sapiens; identical to SEQ ID NO: 12651

SEQ ID NO: 12733 - DNA, 201 bp, Homo sapiens; identical to SEQ ID NO: 12653

SEQ ID NO: 12734 - DNA, 201 bp, Homo sapiens; identical to SEQ ID NO: 12654

SEQ ID NO: 12735 - DNA, 201 bp, Homo sapiens; identical to SEQ ID NO: 12655

SEQ ID NO: 12736 - DNA, 201 bp, Homo sapiens; identical to SEQ ID NO: 12656

SEQ ID NO: 12737 - DNA, 201 bp, Homo sapiens; identical to SEQ ID NO: 12657

SEQ ID NO: 12738 - DNA, 201 bp, Homo sapiens; identical to SEQ ID NO: 12658

SEQ ID NO: 12739 - DNA, 201 bp, Homo sapiens; identical to SEQ ID NO: 12659

SEQ ID NO: 12740 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaagctggctcttgccaccctgccggtctggccccagtggatcctgcccttcctgaggcacaggttc

SEQ ID NO: 12741 - DNA, 201 bp, Homo sapiens; identical to SEQ ID NO: 12661

SEQ ID NO: 12742 - DNA, 201 bp, Homo sapiens
gccccctgggcccccaccatgagacggcacagcagctggaggtgctggagcagcagagcacaagcctcgggcaggacgcacggcggctaggcggccaggcygtggggacccgagaccaggcgagccaattgctggccggcaccgaggccacactgggccatgcgaagacgctgttggcggccatccgggctgtggaccgca

SEQ ID NO: 12743 - DNA, 201 bp, Homo sapiens; identical to SEQ ID NO: 12663

SEQ ID NO: 12744 - DNA, 201 bp, Homo sapiens; identical to SEQ ID NO: 12664

SEQ ID NO: 12745 - DNA, 201 bp, Homo sapiens; identical to SEQ ID NO: 12665

SEQ ID NO: 12746 - DNA, 201 bp, Homo sapiens; identical to SEQ ID NO: 12666

SEQ ID NO: 12747 - DNA, 201 bp, Homo sapiens; identical to SEQ ID NO: 12667

SEQ ID NO: 12748 - DNA, 201 bp, Homo sapiens; identical to SEQ ID NO: 12668

SEQ ID NO: 12749 - DNA, 201 bp, Homo sapiens
ccctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaagctggctcttgccaccctgccggtctggccccagtggatcctgcccttcctgaggcacaggtt

SEQ ID NO: 12750 - DNA, 201 bp, Homo sapiens; identical to SEQ ID NO: 12670

SEQ ID NO: 12751 - DNA, 201 bp, Homo sapiens
ggttctggggactgagccccagcaaccccgagggctgtacccgctgcagctgcgacctcaggggcacactgggtggagttgctgagtgccagccgggcacyggccagtgcttctgcaagccccacgtgtgcggccaggcctgcgcgtcctgcaaggatggcttctttggactggatcaggctgactattttggctgccgca

SEQ ID NO: 12752 - DNA, 201 bp, Homo sapiens; identical to SEQ ID NO: 12671

SEQ ID NO: 12753 - DNA, 201 bp, Homo sapiens; identical to SEQ ID NO: 12673

SEQ ID NO: 12754 - DNA, 201 bp, Homo sapiens; identical to SEQ ID NO: 12674

SEQ ID NO: 12755 - DNA, 201 bp, Homo sapiens
tgcacccggtgcgactgtaccccatgtgggacagaggcctgcgacccccacagcgggcactgcctgtgcaaggcgggcgtgactgggcggcgctgtgaccrctgccaggagggacattttggtttcgatggctgcgggggctgccgcccgtgtgcttgtggaccggccgccgagggctccgagtgccacccccagagcgga

SEQ ID NO: 12756 - DNA, 201 bp, Homo sapiens; identical to SEQ ID NO: 12676

SEQ ID NO: 12757 - DNA, 201 bp, Homo sapiens; identical to SEQ ID NO: 12678

SEQ ID NO: 12758 - DNA, 201 bp, Homo sapiens; identical to SEQ ID NO: 12677

SEQ ID NO: 12759 - DNA, 201 bp, Homo sapiens; identical to SEQ ID NO: 12679

SEQ ID NO: 12760 - DNA, 201 bp, Homo sapiens; identical to SEQ ID NO: 12680

SEQ ID NO: 12761 - DNA, 201 bp, Homo sapiens; identical to SEQ ID NO: 12681

SEQ ID NO: 12762 - DNA, 201 bp, Homo sapiens
tgcaagcccagaccccgggcctggggcctagaggactgcaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggcccagtctctcca

SEQ ID NO: 12763 - DNA, 201 bp, Homo sapiens; identical to SEQ ID NO: 12685

SEQ ID NO: 12764 - DNA, 201 bp, Homo sapiens; identical to SEQ ID NO: 12687

SEQ ID NO: 12765 - DNA, 201 bp, Homo sapiens
gccgcacctaccagccctggcagttctttgcctcctccaagagggactgtctggagcggttcgggccacagacgctggagcgcatcacacgggacgacgcrgccatctgcaccaccgagtactcacgcatcgtgcccctggagaacggagagatcgtggtgtccctggtgaacggacgtccgggcgccatgaatttctcct

SEQ ID NO: 12766 - DNA, 201 bp, Homo sapiens; identical to SEQ ID NO: 12688

SEQ ID NO: 12767 - DNA, 201 bp, Homo sapiens; identical to SEQ ID NO: 12689

SEQ ID NO: 12768 - DNA, 201 bp, Homo sapiens; identical to SEQ ID NO: 12690

SEQ ID NO: 12769 - DNA, 201 bp, Homo sapiens; identical to SEQ ID NO: 12691

SEQ ID NO: 12770 - DNA, 201 bp, Homo sapiens; identical to SEQ ID NO: 12692

SEQ ID NO: 12771 - DNA, 201 bp, Homo sapiens; identical to SEQ ID NO: 12693

SEQ ID NO: 12772 - DNA, 201 bp, Homo sapiens
cgtggcatcaatgccagctccatggcctgggcccgtctgcacaggctgaacgcctccatcgctgacctgcagagccagctccggagccccctgggcccccrccatgagacggcacagcagctggaggtgctggagcagcagagcacaagcctcgggcaggacgcacggcggctaggcggccaggccgtggggacccgagac

SEQ ID NO: 12773 - DNA, 201 bp, Homo sapiens; identical to SEQ ID NO: 12695

SEQ ID NO: 12774 - DNA, 201 bp, Homo sapiens; identical to SEQ ID NO: 12696

SEQ ID NO: 12775 - DNA, 201 bp, Homo sapiens; identical to SEQ ID NO: 12697

SEQ ID NO: 12776 - DNA, 201 bp, Homo sapiens; identical to SEQ ID NO: 12698

SEQ ID NO: 12777 - DNA, 201 bp, Homo sapiens; identical to SEQ ID NO: 12699

SEQ ID NO: 12778 - DNA, 201 bp, Homo sapiens; identical to SEQ ID NO: 12700

SEQ ID NO: 12779 - DNA, 201 bp, Homo sapiens; identical to SEQ ID NO: 12701

SEQ ID NO: 12780 - DNA, 201 bp, Homo sapiens
tgcgagatctgtgcccccggcttctacggcaacgccctgctgcccggcaactgcacccggtgcgactgtaccccatgtgggacagaggcctgcgacccccrcagcgggcactgcctgtgcaaggcgggcgtgactgggcggcgctgtgaccgctgccaggagggacattttggtttcgatggctgcgggggctgccgcccg

SEQ ID NO: 12781 - DNA, 201 bp, Homo sapiens
tcatcaagtttgccaactcaccccggccggacctctgggtgctggagcggtccatggacttcggccgcacctaccagccctggcagttctttgcctcctcyaagagggactgtctggagcggttcgggccacagacgctggagcgcatcacacgggacgacgcggccatctgcaccaccgagtactcacgcatcgtgcccc

SEQ ID NO: 12782 - DNA, 201 bp, Homo sapiens; identical to SEQ ID NO: 12704

SEQ ID NO: 12783 - DNA, 201 bp, Homo sapiens; identical to SEQ ID NO: 12705

SEQ ID NO: 12784 - DNA, 201 bp, Homo sapiens; identical to SEQ ID NO: 12706

SEQ ID NO: 12785 - DNA, 201 bp, Homo sapiens; identical to SEQ ID NO: 12707

SEQ ID NO: 12786 - DNA, 201 bp, Homo sapiens; identical to SEQ ID NO: 12708

SEQ ID NO: 12787 - DNA, 201 bp, Homo sapiens; identical to SEQ ID NO: 12709

SEQ ID NO: 12788 - DNA, 106 bp, Homo sapiens; identical to SEQ ID NO: 12710

SEQ ID NO: 12789 - DNA, 201 bp, Homo sapiens; identical to SEQ ID NO: 12712

SEQ ID NO: 12790 - DNA, 201 bp, Homo sapiens; identical to SEQ ID NO: 12711

SEQ ID NO: 12791 - DNA, 201 bp, Homo sapiens; identical to SEQ ID NO: 12713

SEQ ID NO: 12792 - DNA, 201 bp, Homo sapiens; identical to SEQ ID NO: 12714

SEQ ID NO: 12793 - DNA, 201 bp, Homo sapiens; identical to SEQ ID NO: 12715

SEQ ID NO: 12794 - DNA, 201 bp, Homo sapiens; identical to SEQ ID NO: 12716

SEQ ID NO: 12795 - DNA, 201 bp, Homo sapiens; identical to SEQ ID NO: 12717

SEQ ID NO: 12796 - DNA, 201 bp, Homo sapiens; identical to SEQ ID NO: 12718

SEQ ID NO: 12797 - DNA, 201 bp, Homo sapiens; identical to SEQ ID NO: 12719

SEQ ID NO: 12798 - DNA, 201 bp, Homo sapiens; identical to SEQ ID NO: 12721

SEQ ID NO: 12799 - DNA, 201 bp, Homo sapiens; identical to SEQ ID NO: 12720

SEQ ID NO: 12800 - DNA, 201 bp, Homo sapiens; identical to SEQ ID NO: 12722

SEQ ID NO: 12801 - DNA, 201 bp, Homo sapiens; identical to SEQ ID NO: 12723

SEQ ID NO: 12802 - DNA, 201 bp, Homo sapiens; identical to SEQ ID NO: 12724

SEQ ID NO: 12803 - DNA, 201 bp, Homo sapiens; identical to SEQ ID NO: 12726

SEQ ID NO: 12804 - DNA, 201 bp, Homo sapiens; identical to SEQ ID NO: 12727

SEQ ID NO: 12805 - DNA, 201 bp, Homo sapiens; identical to SEQ ID NO: 12728

SEQ ID NO: 12806 - DNA, 201 bp, Homo sapiens; identical to SEQ ID NO: 12729

SEQ ID NO: 12807 - DNA, 201 bp, Homo sapiens
tgctggtagccaccctgggcctcagccagcggctcttcagcatccgccaccgcagcctccaccggcactcccacgggccccagttcggctccgaggtggarctgagacactcctgaggtgacccggctgggtcggccctgcccaagggcctcccaccagagactgggatgggaacactggtgggcagctgaggacacaccc

SEQ ID NO: 12808 - DNA, 201 bp, Homo sapiens
ctgggcctggacctggatgcgcagcaggcccgcgtgggccagtggctgctgctcttcctgggcatcgccctgctggtagccaccctgggcctcagccagcrgctcttcagcatccgccaccgcagcctccaccggcactcccacgggccccagttcggctccgaggtggagctgagacactcctgaggtgacccggctggg

SEQ ID NO: 12809 - DNA, 201 bp, Homo sapiens
gcagcaggcccgcgtgggccagtggctgctgctcttcctgggcatcgccctgctggtagccaccctgggcctcagccagcggctcttcagcatccgccacmgcagcctccaccggcactcccacgggccccagttcggctccgaggtggagctgagacactcctgaggtgacccggctgggtcggccctgcccaagggcct

SEQ ID NO: 12810 - DNA, 201 bp, Homo sapiens
ctcttcctgggcatcgccctgctggtagccaccctgggcctcagccagcggctcttcagcatccgccaccgcagcctccaccggcactcccacgggccccmgttcggctccgaggtggagctgagacactcctgaggtgacccggctgggtcggccctgcccaagggcctcccaccagagactgggatgggaacactggtg

SEQ ID NO: 12811 - DNA, 201 bp, Homo sapiens
ctcaagaaatgccactatgattagcaggactgggatctggagcgctcttcctgcaggagggcattgagcctaagtaacatttgtctttcctctctctgccrtcccccacactcgcctccagggaacatgtgggcgcagacctggtccaacatctatgacttggtggtgcccttcccttcagccccctcgatggacaccaca

SEQ ID NO: 12812 - DNA, 201 bp, Homo sapiens
acgggcgggaggtggtctgccacgcctcggcctgggacttctacaacggcaaggacttccggatcaagcagtgcaccaccgtgaacttggaggacctggtrgtggcccaccacgaaatgggccacatccagtatttcatgcagtacaaagacttacctgtggccttgagggagggtgccaaccccggcttccatgaggcca

SEQ ID NO: 12813 - DNA, 201 bp, Homo sapiens
gtggcccaccacgaaatgggccacatccagtatttcatgcagtacaaagacttacctgtggccttgagggagggtgccaaccccggcttccatgaggccaytggggacgtgctagccctctcagtgtctacgcccaagcacctgcacagtctcaacctgctgagcagtgagggtggcagcgacgagcatgacatcaacttt

SEQ ID NO: 12814 - DNA, 201 bp, Homo sapiens
tgcccttcccttcagccccctcgatggacaccacagaggctatgctaaagcagggctggacgcccaggaggatgtttaaggaggctgatgatttcttcacytccctggggctgctgcccgtgcctcctgagttctggaacaagtcgatgctggagaagccaaccgacgggcgggaggtggtctgccacgcctcggcctggg

SEQ ID NO: 12815 - DNA, 201 bp, Homo sapiens
atgtgggcgcagacctggtccaacatctatgacttggtggtgcccttcccttcagccccctcgatggacaccacagaggctatgctaaagcagggctggaygcccaggaggatgtttaaggaggctgatgatttcttcacctccctggggctgctgcccgtgcctcctgagttctggaacaagtcgatgctggagaagcca

SEQ ID NO: 12816 - DNA, 201 bp, Homo sapiens
agtaccagggcctctgccccccagtgcccaggactcaaggtgactttgacccaggggccaagttccacattccttctagcgtgccttacatcaggtacttygtcagcttcatcatccagttccagttccacgaggcactgtgccaggcagctggccacacgggccccctgcacaagtgtgacatctaccagtccaaggagg

SEQ ID NO: 12817 - DNA, 201 bp, Homo sapiens
tcggccatgttgagctacttcaagccgctgctggactggctccgcacggagaacgagctgcatggggagaagctgggctggccgcagtacaactggacgcygaactccgctcgctcagaagggcccctcccagacagcggccgcgtcagcttcctgggcctggacctggatgcgcagcaggcccgcgtgggccagtggctg

SEQ ID NO: 12818 - DNA, 201 bp, Homo sapiens
gagccatcctccagttttacccgaaatacgtggaactcatcaaccaggctgcccggctcaatggctatgtagatgcaggggactcgtggaggtctatgtaygagacaccatccctggagcaagacctggagcggctcttccaggagctgcagccactctacctcaacctgcatgcctacgtgcgccgggccctgcaccgtc

SEQ ID NO: 12819 - DNA, 201 bp, Homo sapiens; identical to SEQ ID NO: 12813

SEQ ID NO: 12820 - DNA, 201 bp, Homo sapiens
gcagctgcctgcagctcgagccagatctgacgaatgtgatggccacgtcccggaaatatgaagacctgttatgggcatgggagggctggcgagacaaggcrgggagagccatcctccagttttacccgaaatacgtggaactcatcaaccaggctgcccggctcaatggctatgtagatgcaggggactcgtggaggtcta

SEQ ID NO: 12821 - DNA, 201 bp, Homo sapiens; identical to SEQ ID NO: 12815

SEQ ID NO: 12822 - DNA, 201 bp, Homo sapiens
cctgctgctctgctacgggcaccctctgctggtccccagccaggaggcatcccaacaggtgacagtcacccatgggacaagcagccaggcaacaaccagcrgccagacaaccacccaccaggcgacggcccaccagacatcagcccagagcccaaacctggtgactgatgaggctgaggccagcaagtttgtggaggaata

SEQ ID NO: 12823 - DNA, 201 bp, Homo sapiens
gggagagccatcctccagttttacccgaaatacgtggaactcatcaaccaggctgcccggctcaatggctatgtagatgcaggggactcgtggaggtctaygtacgagacaccatccctggagcaagacctggagcggctcttccaggagctgcagccactctacctcaacctgcatgcctacgtgcgccgggccctgcac

SEQ ID NO: 12824 - DNA, 201 bp, Homo sapiens
atgaccggacatcccaggtggtgtggaacgagtatgccgaggccaactggaactacaacaccaacatcaccacagagaccagcaagattctgggcctttamgacacttgggggtcttctcttctctgcccctgcctggatatgtgttgcttgaccgcaggcatccagggaggctgcagaagaacatgcaaatagccaacca

SEQ ID NO: 12825 - DNA, 201 bp, Homo sapiens
tgaagtacggcacccaggccaggaagtttgatgtgaaccagttgcagaacaccactatcaagcggatcataaagaaggttcaggacctagaacgggcagcrctgcctgcccaggagctggaggagtacaacaagatcctgttggatatggaaaccacctacagcgtggccactgtgtgccacccgaatggcagctgcctgc

SEQ ID NO: 12826 - DNA, 201 bp, Homo sapiens
tcctgttggatatggaaaccacctacagcgtggccactgtgtgccacccgaatggcagctgcctgcagctcgagccagatctgacgaatgtgatggccacrtcccggaaatatgaagacctgttatgggcatgggagggctggcgagacaaggcggggagagccatcctccagttttacccgaaatacgtggaactcatca

SEQ ID NO: 12827 - DNA, 201 bp, Homo sapiens
tgcggccatgggccagggttgggctactgcaggacttcccagcctcctcttcctgctgctctgctacgggcaccctctgctggtccccagccaggaggcaycccaacaggtgacagtcacccatgggacaagcagccaggcaacaaccagcagccagacaaccacccaccaggcgacggcccaccagacatcagcccagag

SEQ ID NO: 12828 - DNA, 113 bp, Homo sapiens
actgcgggctccrctcttattggccaggggacggtagctgcaggactctgctctcctgcggccatgggccagggttgggctactgcaggacttcccagcctcctcttcctgct

SEQ ID NO: 12829 - DNA, 201 bp, Homo sapiens; identical to SEQ ID NO: 12816

SEQ ID NO: 12830 - DNA, 201 bp, Homo sapiens
gactctgctctcctgcggccatgggccagggttgggctactgcaggacttcccagcctcctcttcctgctgctctgctacgggcaccctctgctggtcccyagccaggaggcatcccaacaggtgacagtcacccatgggacaagcagccaggcaacaaccagcagccagacaaccacccaccaggcgacggcccaccaga

SEQ ID NO: 12831 - DNA, 201 bp, Homo sapiens
gctatgtagatgcaggggactcgtggaggtctatgtacgagacaccatccctggagcaagacctggagcggctcttccaggagctgcagccactctacctsaacctgcatgcctacgtgcgccgggccctgcaccgtcactacggggcccagcacatcaacctggaggggcccattcctgctcacctgctggggaacatgt

SEQ ID NO: 12832 - DNA, 201 bp, Homo sapiens; identical to SEQ ID NO: 12807

SEQ ID NO: 12833 - DNA, 201 bp, Homo sapiens; identical to SEQ ID NO: 12808

SEQ ID NO: 12834 - DNA, 201 bp, Homo sapiens; identical to SEQ ID NO: 12809

SEQ ID NO: 12835 - DNA, 201 bp, Homo sapiens; identical to SEQ ID NO: 12810

SEQ ID NO: 12836 - DNA, 201 bp, Homo sapiens; identical to SEQ ID NO: 12812

SEQ ID NO: 12837 - DNA, 201 bp, Homo sapiens
acaccctgaagtacggcacccaggccaggaagtttgatgtgaaccagttgcagaacaccactatcaagcggatcataaagaaggttcaggacctagaacgkgcagcactgcctgcccaggagctggaggagtacaacaagatcctgttggatatggaaaccacctacagcgtggccactgtgtgccacccgaatggcagct

SEQ ID NO: 12838 - DNA, 201 bp, Homo sapiens; identical to SEQ ID NO: 12814

SEQ ID NO: 12839 - DNA, 201 bp, Homo sapiens
ggaactcatcaaccaggctgcccggctcaatggctatgtagatgcaggggactcgtggaggtctatgtacgagacaccatccctggagcaagacctggagmggctcttccaggagctgcagccactctacctcaacctgcatgcctacgtgcgccgggccctgcaccgtcactacggggcccagcacatcaacctggaggg

SEQ ID NO: 12840 - DNA, 201 bp, Homo sapiens; identical to SEQ ID NO: 12817

SEQ ID NO: 12841 - DNA, 201 bp, Homo sapiens
tgtatgaaccgatctggcagaacttcacggacccgcagctgcgcaggatcatcggagctgtgcgcaccctgggctctgccaacctgcccctggctaagcgkcagcagtacaacgccctgctaagcaacatgagcaggatctactccaccgccaaggtctgcctccccaacaagactgccacctgctggtccctggacccag

SEQ ID NO: 12842 - DNA, 201 bp, Homo sapiens
agactgccacctgctggtccctggacccagatctcaccaacatcctggcttcctcgcgaagctacgccatgctcctgtttgcctgggagggctggcacaaygctgcgggcatcccgctgaaaccgctgtacgaggatttcactgccctcagcaatgaagcctacaagcaggacggcttcacagacacgggggcctactggc

SEQ ID NO: 12843 - DNA, 201 bp, Homo sapiens
ccctggacccagatctcaccaacatcctggcttcctcgcgaagctacgccatgctcctgtttgcctgggagggctggcacaacgctgcgggcatcccgctraaaccgctgtacgaggatttcactgccctcagcaatgaagcctacaagcaggacggcttcacagacacgggggcctactggcgctcctggtacaactccc

SEQ ID NO: 12844 - DNA, 201 bp, Homo sapiens; identical to SEQ ID NO: 12813

SEQ ID NO: 12845 - DNA, 201 bp, Homo sapiens
ggaaaacatctacgacatggtggtgcctttcccagacaagcccaacctcgatgtcaccagtactatgctgcagcagggctggaacgccacgcacatgttcygggtggcagaggagttcttcacctccctggagctctcccccatgcctcccgagttctgggaagggtcgatgctggagaagccggccgacgggcgggaagt

SEQ ID NO: 12846 - DNA, 201 bp, Homo sapiens
ggcgctcctggtacaactcccccaccttcgaggacgatctggaacacctctaccaacagctagagcccctctacctgaacctccatgccttcgtccgccgygcactgcatcgccgatacggagacagatacatcaacctcaggggacccatccctgctcatctgctgggagacatgtgggcccagagctgggaaaacatct

SEQ ID NO: 12847 - DNA, 201 bp, Homo sapiens
gcgctcctggtacaactcccccaccttcgaggacgatctggaacacctctaccaacagctagagcccctctacctgaacctccatgccttcgtccgccgckcactgcatcgccgatacggagacagatacatcaacctcaggggacccatccctgctcatctgctgggagacatgtgggcccagagctgggaaaacatcta

SEQ ID NO: 12848 - DNA, 201 bp, Homo sapiens; identical to SEQ ID NO: 12823

SEQ ID NO: 12849 - DNA, 201 bp, Homo sapiens
tcgatgctggagaagccggccgacgggcgggaagtggtgtgccacgcctcggcttgggacttctacaacaggaaagacttcaggatcaagcagtgcacacrggtcacgatggaccagctctccacagtgcaccatgagatgggccatatacagtactacctgcagtacaaggatctgcccgtctccctgcgtcggggggcc

SEQ ID NO: 12850 - DNA, 201 bp, Homo sapiens
tcaggatcaagcagtgcacacgggtcacgatggaccagctctccacagtgcaccatgagatgggccatatacagtactacctgcagtacaaggatctgccygtctccctgcgtcggggggccaaccccggcttccatgaggccattggggacgtgctggcgctctcggtctccactcctgaacatctgcacaaaatcggcc

SEQ ID NO: 12851 - DNA, 201 bp, Homo sapiens; identical to SEQ ID NO: 12825

SEQ ID NO: 12852 - DNA, 201 bp, Homo sapiens; identical to SEQ ID NO: 12807

SEQ ID NO: 12853 - DNA, 201 bp, Homo sapiens
ccggcttccatgaggccattggggacgtgctggcgctctcggtctccactcctgaacatctgcacaaaatcggcctgctggaccgtgtcaccaatgacacsgaaagtgacatcaattacttgctaaaaatggcactggaaaaaattgccttcctgccctttggctacttggtggaccagtggcgctggggggtctttagtg

SEQ ID NO: 12854 - DNA, 201 bp, Homo sapiens; identical to SEQ ID NO: 12812

SEQ ID NO: 12855 - DNA, 201 bp, Homo sapiens
atttctgctccaccattcccatgaggcagattccctccagaaggaggaagcgcggcttccgcaaactaaggtctcccgcagggatctccccagggcccggkctctggaagcccttggccttcctcccctcccccagcaccgtggcttctcctttatggcctgcatctaagcagggtcctacaccctccctgccctcctggt

SEQ ID NO: 12856 - DNA, 201 bp, Homo sapiens; identical to SEQ ID NO: 12837

SEQ ID NO: 12857 - DNA, 163 bp, Homo sapiens
cccgagcgccgggctgcgcgcacggcctacgctcccagcatgcacgagttggatggatgaggstggctgctcccaggccgcgcccgccttcgccgaaggtgctgggcttggctctggggcccccgcgctctcgggcagctgccttctcacctccggacgctgt

SEQ ID NO: 12858 - DNA, 201 bp, Homo sapiens
aacgccacgcacatgttccgggtggcagaggagttcttcacctccctggagctctcccccatgcctcccgagttctgggaagggtcgatgctggagaagcyggccgacgggcgggaagtggtgtgccacgcctcggcttgggacttctacaacaggaaagacttcaggatcaagcagtgcacacgggtcacgatggaccag

SEQ ID NO: 12859 - DNA, 201 bp, Homo sapiens
tcgccgatacggagacagatacatcaacctcaggggacccatccctgctcatctgctgggagacatgtgggcccagagctgggaaaacatctacgacatgrtggtgcctttcccagacaagcccaacctcgatgtcaccagtactatgctgcagcagggctggaacgccacgcacatgttccgggtggcagaggagttctt

SEQ ID NO: 12860 - DNA, 201 bp, Homo sapiens
atgtcaccagtactatgctgcagcagggctggaacgccacgcacatgttccgggtggcagaggagttcttcacctccctggagctctcccccatgcctccygagttctgggaagggtcgatgctggagaagccggccgacgggcgggaagtggtgtgccacgcctcggcttgggacttctacaacaggaaagacttcagga

SEQ ID NO: 12861 - DNA, 201 bp, Homo sapiens
gtgggcccagagctgggaaaacatctacgacatggtggtgcctttcccagacaagcccaacctcgatgtcaccagtactatgctgcagcagggctggaackccacgcacatgttccgggtggcagaggagttcttcacctccctggagctctcccccatgcctcccgagttctgggaagggtcgatgctggagaagccggc

SEQ ID NO: 12862 - DNA, 201 bp, Homo sapiens
acatgagcaggatctactccaccgccaaggtctgcctccccaacaagactgccacctgctggtccctggacccagatctcaccaacatcctggcttcctckcgaagctacgccatgctcctgtttgcctgggagggctggcacaacgctgcgggcatcccgctgaaaccgctgtacgaggatttcactgccctcagcaatg

SEQ ID NO: 12863 - DNA, 201 bp, Homo sapiens; identical to SEQ ID NO: 12818

SEQ ID NO: 12864 - DNA, 201 bp, Homo sapiens; identical to SEQ ID NO: 12820

SEQ ID NO: 12865 - DNA, 201 bp, Homo sapiens; identical to SEQ ID NO: 12815

SEQ ID NO: 12866 - DNA, 201 bp, Homo sapiens
cgtcggggggccaaccccggcttccatgaggccattggggacgtgctggcgctctcggtctccactcctgaacatctgcacaaaatcggcctgctggaccrtgtcaccaatgacacggaaagtgacatcaattacttgctaaaaatggcactggaaaaaattgccttcctgccctttggctacttggtggaccagtggcgc

SEQ ID NO: 12867 - DNA, 201 bp, Homo sapiens
catcaggtactttgtgagttttgtcctgcagttccagttccatgaagccctgtgcaaggaggcaggctatgagggcccactgcaccagtgtgacatctacyggtccaccaaggcaggggccaagctccggaaggtgctgcaggctggctcctccaggccctggcaggaggtgctgaaggacatggtcggcttagatgccct

SEQ ID NO: 12868 - DNA, 201 bp, Homo sapiens
acatctacgacatggtggtgcctttcccagacaagcccaacctcgatgtcaccagtactatgctgcagcagggctggaacgccacgcacatgttccgggtkgcagaggagttcttcacctccctggagctctcccccatgcctcccgagttctgggaagggtcgatgctggagaagccggccgacgggcgggaagtggtgt

SEQ ID NO: 12869 - DNA, 201 bp, Homo sapiens
catcggagctgtgcgcaccctgggctctgccaacctgcccctggctaagcggcagcagtacaacgccctgctaagcaacatgagcaggatctactccaccrccaaggtctgcctccccaacaagactgccacctgctggtccctggacccagatctcaccaacatcctggcttcctcgcgaagctacgccatgctcctgtt

SEQ ID NO: 12870 - DNA, 201 bp, Homo sapiens; identical to SEQ ID NO: 12826

SEQ ID NO: 12871 - DNA, 201 bp, Homo sapiens; identical to SEQ ID NO: 12816

SEQ ID NO: 12872 - DNA, 201 bp, Homo sapiens
atctaccggtccaccaaggcaggggccaagctccggaaggtgctgcaggctggctcctccaggccctggcaggaggtgctgaaggacatggtcggcttagrtgccctggatgcccagccgctgctcaagtacttccagccagtcacccagtggctgcaggagcagaaccagcagaacggcgaggtcctgggctggcccgag

SEQ ID NO: 12873 - DNA, 201 bp, Homo sapiens; identical to SEQ ID NO: 12831

SEQ ID NO: 12874 - DNA, 201 bp, Homo sapiens; identical to SEQ ID NO: 12808

SEQ ID NO: 12875 - DNA, 201 bp, Homo sapiens; identical to SEQ ID NO: 12809

SEQ ID NO: 12876 - DNA, 201 bp, Homo sapiens
gactggtggtatcttcgaaccaagtatcaggggatctgtcctcctgttacccgaaacgaaacccactttgatgctggagctaagtttcatgttccaaatgygacaccatacatcaggtactttgtgagttttgtcctgcagttccagttccatgaagccctgtgcaaggaggcaggctatgagggcccactgcaccagtgt

SEQ ID NO: 12877 - DNA, 201 bp, Homo sapiens; identical to SEQ ID NO: 12810

SEQ ID NO: 12878 - DNA, 201 bp, Homo sapiens
tgcagcagggctggaacgccacgcacatgttccgggtggcagaggagttcttcacctccctggagctctcccccatgcctcccgagttctgggaagggtcsatgctggagaagccggccgacgggcgggaagtggtgtgccacgcctcggcttgggacttctacaacaggaaagacttcaggatcaagcagtgcacacggg

SEQ ID NO: 12879 - DNA, 201 bp, Homo sapiens; identical to SEQ ID NO: 12814

SEQ ID NO: 12880 - DNA, 201 bp, Homo sapiens
agcaatgaagcctacaagcaggacggcttcacagacacgggggcctactggcgctcctggtacaactcccccaccttcgaggacgatctggaacacctctrccaacagctagagcccctctacctgaacctccatgccttcgtccgccgcgcactgcatcgccgatacggagacagatacatcaacctcaggggacccatc

SEQ ID NO: 12881 - DNA, 201 bp, Homo sapiens; identical to SEQ ID NO: 12839

SEQ ID NO: 12882 - DNA, 201 bp, Homo sapiens; identical to SEQ ID NO: 12817

SEQ ID NO: 12883 - DNA, 201 bp, Homo sapiens; identical to SEQ ID NO: 12818

SEQ ID NO: 12884 - DNA, 201 bp, Homo sapiens; identical to SEQ ID NO: 12813

SEQ ID NO: 12885 - DNA, 201 bp, Homo sapiens; identical to SEQ ID NO: 12820

SEQ ID NO: 12886 - DNA, 201 bp, Homo sapiens; identical to SEQ ID NO: 12815

SEQ ID NO: 12887 - DNA, 201 bp, Homo sapiens; identical to SEQ ID NO: 12822

SEQ ID NO: 12888 - DNA, 201 bp, Homo sapiens; identical to SEQ ID NO: 12823

SEQ ID NO: 12889 - DNA, 113 bp, Homo sapiens; identical to SEQ ID NO: 12828

SEQ ID NO: 12890 - DNA, 201 bp, Homo sapiens; identical to SEQ ID NO: 12827

SEQ ID NO: 12891 - DNA, 201 bp, Homo sapiens; identical to SEQ ID NO: 12826

SEQ ID NO: 12892 - DNA, 201 bp, Homo sapiens; identical to SEQ ID NO: 12825

SEQ ID NO: 12893 - DNA, 201 bp, Homo sapiens; identical to SEQ ID NO: 12830

SEQ ID NO: 12894 - DNA, 201 bp, Homo sapiens; identical to SEQ ID NO: 12816

SEQ ID NO: 12895 - DNA, 201 bp, Homo sapiens; identical to SEQ ID NO: 12808

SEQ ID NO: 12896 - DNA, 201 bp, Homo sapiens; identical to SEQ ID NO: 12831

SEQ ID NO: 12897 - DNA, 201 bp, Homo sapiens; identical to SEQ ID NO: 12807

SEQ ID NO: 12898 - DNA, 201 bp, Homo sapiens; identical to SEQ ID NO: 12809

SEQ ID NO: 12899 - DNA, 201 bp, Homo sapiens; identical to SEQ ID NO: 12810

SEQ ID NO: 12900 - DNA, 201 bp, Homo sapiens; identical to SEQ ID NO: 12812

SEQ ID NO: 12901 - DNA, 201 bp, Homo sapiens; identical to SEQ ID NO: 12837

SEQ ID NO: 12902 - DNA, 201 bp, Homo sapiens; identical to SEQ ID NO: 12814

SEQ ID NO: 12903 - DNA, 201 bp, Homo sapiens; identical to SEQ ID NO: 12839

SEQ ID NO: 12904 - DNA, 201 bp, Homo sapiens; identical to SEQ ID NO: 12817

SEQ ID NO: 12905 - DNA, 201 bp, Homo sapiens; identical to SEQ ID NO: 12807

SEQ ID NO: 12906 - DNA, 201 bp, Homo sapiens; identical to SEQ ID NO: 12808

SEQ ID NO: 12907 - DNA, 201 bp, Homo sapiens; identical to SEQ ID NO: 12809

SEQ ID NO: 12908 - DNA, 201 bp, Homo sapiens; identical to SEQ ID NO: 12810

SEQ ID NO: 12909 - DNA, 201 bp, Homo sapiens; identical to SEQ ID NO: 12816

SEQ ID NO: 12910 - DNA, 201 bp, Homo sapiens; identical to SEQ ID NO: 12817

SEQ ID NO: 12911 - DNA, 201 bp, Homo sapiens; identical to SEQ ID NO: 12818

SEQ ID NO: 12912 - DNA, 201 bp, Homo sapiens; identical to SEQ ID NO: 12813

SEQ ID NO: 12913 - DNA, 201 bp, Homo sapiens; identical to SEQ ID NO: 12820

SEQ ID NO: 12914 - DNA, 201 bp, Homo sapiens; identical to SEQ ID NO: 12815

SEQ ID NO: 12915 - DNA, 201 bp, Homo sapiens; identical to SEQ ID NO: 12823

SEQ ID NO: 12916 - DNA, 199 bp, Homo sapiens
cggccatgggccagggttgggctactgcaggacttcccagcctcctcttcctgctgctctgctacgggcaccctctgctggtccccagccaggaggcaycccaacagacctggtgactgatgaggctgaggccagcaagtttgtggaggaatatgaccggacatcccaggtggtgtggaacgagtatgccgaggccaac

SEQ ID NO: 12917 - DNA, 201 bp, Homo sapiens; identical to SEQ ID NO: 12826

SEQ ID NO: 12918 - DNA, 201 bp, Homo sapiens; identical to SEQ ID NO: 12825

SEQ ID NO: 12919 - DNA, 186 bp, Homo sapiens
cggccatgggccagggttgggctactgcaggacttcccagcctcctcttcctgctgctctgctacgggcaccctctgctggtcccyagccaggaggcatcccaacagacctggtgactgatgaggctgaggccagcaagtttgtggaggaatatgaccggacatcccaggtggtgtggaacgagta

SEQ ID NO: 12920 - DNA, 201 bp, Homo sapiens; identical to SEQ ID NO: 12816

SEQ ID NO: 12921 - DNA, 201 bp, Homo sapiens; identical to SEQ ID NO: 12831

SEQ ID NO: 12922 - DNA, 201 bp, Homo sapiens; identical to SEQ ID NO: 12807

SEQ ID NO: 12923 - DNA, 201 bp, Homo sapiens; identical to SEQ ID NO: 12808

SEQ ID NO: 12924 - DNA, 201 bp, Homo sapiens; identical to SEQ ID NO: 12809

SEQ ID NO: 12925 - DNA, 201 bp, Homo sapiens; identical to SEQ ID NO: 12810

SEQ ID NO: 12926 - DNA, 201 bp, Homo sapiens; identical to SEQ ID NO: 12812

SEQ ID NO: 12927 - DNA, 201 bp, Homo sapiens; identical to SEQ ID NO: 12837

SEQ ID NO: 12928 - DNA, 201 bp, Homo sapiens; identical to SEQ ID NO: 12814

SEQ ID NO: 12929 - DNA, 201 bp, Homo sapiens; identical to SEQ ID NO: 12839

SEQ ID NO: 12930 - DNA, 201 bp, Homo sapiens; identical to SEQ ID NO: 12817

SEQ ID NO: 12931 - DNA, 201 bp, Homo sapiens; identical to SEQ ID NO: 12818

SEQ ID NO: 12932 - DNA, 201 bp, Homo sapiens
tcagcctctagcaccaggactcagaggatgaggtcaatttcctgatgcatattgccctggagaagatcgccttcatcccctttggctacctgatggacctstttcgctggaaggtctttgacggcaccatctggaaggacatctacaatcaggagtggtggaacctcaggttgaaataccagggcttgtgccccgctattc

SEQ ID NO: 12933 - DNA, 201 bp, Homo sapiens; identical to SEQ ID NO: 12813

SEQ ID NO: 12934 - DNA, 201 bp, Homo sapiens
cagcctctagcaccaggactcagaggatgaggtcaatttcctgatgcatattgccctggagaagatcgccttcatcccctttggctacctgatggacctgyttcgctggaaggtctttgacggcaccatctggaaggacatctacaatcaggagtggtggaacctcaggttgaaataccagggcttgtgccccgctattcc

SEQ ID NO: 12935 - DNA, 201 bp, Homo sapiens; identical to SEQ ID NO: 12820

SEQ ID NO: 12936 - DNA, 201 bp, Homo sapiens
ctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcaca

SEQ ID NO: 12937 - DNA, 201 bp, Homo sapiens; identical to SEQ ID NO: 12815

SEQ ID NO: 12938 - DNA, 201 bp, Homo sapiens; identical to SEQ ID NO: 12822

SEQ ID NO: 12939 - DNA, 201 bp, Homo sapiens
gaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaaggtaaccc

SEQ ID NO: 12940 - DNA, 201 bp, Homo sapiens; identical to SEQ ID NO: 12823

SEQ ID NO: 12941 - DNA, 201 bp, Homo sapiens; identical to SEQ ID NO: 12826

SEQ ID NO: 12942 - DNA, 201 bp, Homo sapiens; identical to SEQ ID NO: 12825

SEQ ID NO: 12943 - DNA, 201 bp, Homo sapiens; identical to SEQ ID NO: 12827

SEQ ID NO: 12944 - DNA, 102 bp, Homo sapiens
crctcttattggccaggggacggtagctgcaggactctgctctcctgcggccatgggccagggttgggctactgcaggacttcccagcctcctcttcctgct

SEQ ID NO: 12945 - DNA, 201 bp, Homo sapiens; identical to SEQ ID NO: 12830

SEQ ID NO: 12946 - DNA, 201 bp, Homo sapiens; identical to SEQ ID NO: 12816

SEQ ID NO: 12947 - DNA, 201 bp, Homo sapiens; identical to SEQ ID NO: 12831

SEQ ID NO: 12948 - DNA, 201 bp, Homo sapiens
aagcaagccctggccagaggtcctaaagatgctgactggggagtctgaggtgtctacaaatgtcttcatgacctacttcaaacccctactgacctggctgstgacagaacatgcagcaaggggacatcttaggctggccagacttcagctgttcctttgaagaaaaagacacagacaaagtgacattcctgagtctgaagc

SEQ ID NO: 12949 - DNA, 201 bp, Homo sapiens
gctattcctcactcagaggaagactttgatccaggtgccaagttccacttttctgctggtacttcctcagtctggtgctccagttccagttccacgaaacmctgtgcaaagcctcgggccacatgggtccactgcaccagtgtgacatctacaactccaagattgccgggaagctcctgggggatgctctaaagctgggct

SEQ ID NO: 12950 - DNA, 201 bp, Homo sapiens; identical to SEQ ID NO: 12812

SEQ ID NO: 12951 - DNA, 201 bp, Homo sapiens; identical to SEQ ID NO: 12814

SEQ ID NO: 12952 - DNA, 201 bp, Homo sapiens; identical to SEQ ID NO: 12837

SEQ ID NO: 12953 - DNA, 201 bp, Homo sapiens
aaagacatgggggccttgtggcactccaagtatgagtcggataccctggagcaagacctggagcggctattccaggagctgcggccactctacctgaaccygcacacctacgtgcgcagggccctccaccgccactatgggcccgagctcatcgacctgagggggcccatccctgcccacctcctggagaacacgttggct

SEQ ID NO: 12954 - DNA, 201 bp, Homo sapiens
actggacgccgaactccgatgacttctacaatgagaccgagaccaagatcttcctgcagttttatgaccaaacagggatttgggaccatggggcaccacayctcctgcccccatcccaagcaagaggaacaagggaagccccagtgtacatgtcaaagagggctgcaagctctgggcctcctggaagccctaatcttcctc

SEQ ID NO: 12955 - DNA, 201 bp, Homo sapiens
caccacacctcctgcccccatcccaagcaagaggaacaagggaagccccagtgtacatgtcaaagagggctgcaagctctgggcctcctggaagccctaawcttcctccagctgcacaaggacatggagaggtcccagttcatgatttactttggcacccaggcccacctgtttaaagtcacccagttcaaggacccggat

SEQ ID NO: 12956 - DNA, 201 bp, Homo sapiens
aggagtggtggaacctcaggttgaaataccagggcttgtgccccgctattcctcactcagaggaagactttgatccaggtgccaagttccacttttctgcwggtacttcctcagtctggtgctccagttccagttccacgaaacactgtgcaaagcctcgggccacatgggtccactgcaccagtgtgacatctacaactc

SEQ ID NO: 12957 - DNA, 201 bp, Homo sapiens
agaatcactggaacctgggagccggaggctgcagtgagccaagatcgcaccattgcactccagctgggagacacagcaagactccgtctcaaaagaaaaamaaaaaaaagaacaactgccaagaataaagaagtgcgcggaagtgaccacagaagacccgctctccatcttccacgaaatgggccattccagtacttcctg

SEQ ID NO: 12958 - DNA, 201 bp, Homo sapiens
agtgcgcggaagtgaccacagaagacccgctctccatcttccacgaaatgggccattccagtacttcctgcagtacaagaacctctccatcatcttccgcrcaggtgccaacccagcctttgaagaggctgtggggtctgtgatcaccctctcggcctcctcccacaagcacctgctcaacataggcctgctcagcctcta

SEQ ID NO: 12959 - DNA, 201 bp, Homo sapiens; identical to SEQ ID NO: 12839

SEQ ID NO: 12960 - DNA, 201 bp, Homo sapiens
tcggccatgttgagctacttcaagccgctgctggactggctccgcacggagaacgagctgcatggggagaagctgggctggccgcagtacaactggacgcygaactccgatgacttctacaatgagaccgagaccaagatcttcctgcagttttatgaccaaacagggatttgggaccatggggcaccacacctcctgccc

SEQ ID NO: 12961 - DNA, 201 bp, Homo sapiens; identical to SEQ ID NO: 12841

SEQ ID NO: 12962 - DNA, 201 bp, Homo sapiens; identical to SEQ ID NO: 12842

SEQ ID NO: 12963 - DNA, 201 bp, Homo sapiens; identical to SEQ ID NO: 12843

SEQ ID NO: 12964 - DNA, 167 bp, Homo sapiens
gccgagcaccgcgcaccgcgtcatgggggccgcctcgggccgccgggggccggggctgctgctgccsctgccgctgctgttgctgctgccgccgcagcccgccctggcgttggaccccgggctgcagcccggcaacttttctgctgacgaggccggggcgcagctct

SEQ ID NO: 12965 - DNA, 201 bp, Homo sapiens; identical to SEQ ID NO: 12813

SEQ ID NO: 12966 - DNA, 201 bp, Homo sapiens; identical to SEQ ID NO: 12845

SEQ ID NO: 12967 - DNA, 201 bp, Homo sapiens; identical to SEQ ID NO: 12846

SEQ ID NO: 12968 - DNA, 201 bp, Homo sapiens; identical to SEQ ID NO: 12847

SEQ ID NO: 12969 - DNA, 201 bp, Homo sapiens; identical to SEQ ID NO: 12823

SEQ ID NO: 12970 - DNA, 201 bp, Homo sapiens; identical to SEQ ID NO: 12850

SEQ ID NO: 12971 - DNA, 201 bp, Homo sapiens; identical to SEQ ID NO: 12849

SEQ ID NO: 12972 - DNA, 201 bp, Homo sapiens; identical to SEQ ID NO: 12825

SEQ ID NO: 12973 - DNA, 201 bp, Homo sapiens; identical to SEQ ID NO: 12807

SEQ ID NO: 12974 - DNA, 201 bp, Homo sapiens; identical to SEQ ID NO: 12853

SEQ ID NO: 12975 - DNA, 201 bp, Homo sapiens; identical to SEQ ID NO: 12812

SEQ ID NO: 12976 - DNA, 201 bp, Homo sapiens; identical to SEQ ID NO: 12837

SEQ ID NO: 12977 - DNA, 201 bp, Homo sapiens; identical to SEQ ID NO: 12858

SEQ ID NO: 12978 - DNA, 201 bp, Homo sapiens; identical to SEQ ID NO: 12859

SEQ ID NO: 12979 - DNA, 201 bp, Homo sapiens; identical to SEQ ID NO: 12860

SEQ ID NO: 12980 - DNA, 201 bp, Homo sapiens; identical to SEQ ID NO: 12861

SEQ ID NO: 12981 - DNA, 201 bp, Homo sapiens; identical to SEQ ID NO: 12862

SEQ ID NO: 12982 - DNA, 201 bp, Homo sapiens; identical to SEQ ID NO: 12818

SEQ ID NO: 12983 - DNA, 201 bp, Homo sapiens; identical to SEQ ID NO: 12820

SEQ ID NO: 12984 - DNA, 201 bp, Homo sapiens; identical to SEQ ID NO: 12815

SEQ ID NO: 12985 - DNA, 201 bp, Homo sapiens; identical to SEQ ID NO: 12866

SEQ ID NO: 12986 - DNA, 201 bp, Homo sapiens; identical to SEQ ID NO: 12867

SEQ ID NO: 12987 - DNA, 201 bp, Homo sapiens; identical to SEQ ID NO: 12868

SEQ ID NO: 12988 - DNA, 201 bp, Homo sapiens; identical to SEQ ID NO: 12869

SEQ ID NO: 12989 - DNA, 201 bp, Homo sapiens; identical to SEQ ID NO: 12826

SEQ ID NO: 12990 - DNA, 201 bp, Homo sapiens; identical to SEQ ID NO: 12816

SEQ ID NO: 12991 - DNA, 201 bp, Homo sapiens; identical to SEQ ID NO: 12872

SEQ ID NO: 12992 - DNA, 119 bp, Homo sapiens
gccgagcaccgcgcaccgsgtcatgggggccgcctcgggccgccgggggccggggctgctgctgccgctgccgctgctgttgctgctgccgccgcagcccgccctggcgttggaccccg

SEQ ID NO: 12993 - DNA, 201 bp, Homo sapiens; identical to SEQ ID NO: 12831

SEQ ID NO: 12994 - DNA, 201 bp, Homo sapiens; identical to SEQ ID NO: 12808

SEQ ID NO: 12995 - DNA, 201 bp, Homo sapiens; identical to SEQ ID NO: 12809

SEQ ID NO: 12996 - DNA, 201 bp, Homo sapiens; identical to SEQ ID NO: 12876

SEQ ID NO: 12997 - DNA, 201 bp, Homo sapiens; identical to SEQ ID NO: 12810

SEQ ID NO: 12998 - DNA, 201 bp, Homo sapiens; identical to SEQ ID NO: 12878

SEQ ID NO: 12999 - DNA, 201 bp, Homo sapiens; identical to SEQ ID NO: 12814

SEQ ID NO: 13000 - DNA, 201 bp, Homo sapiens; identical to SEQ ID NO: 12880

SEQ ID NO: 13001 - DNA, 201 bp, Homo sapiens; identical to SEQ ID NO: 12839

SEQ ID NO: 13002 - DNA, 201 bp, Homo sapiens; identical to SEQ ID NO: 12817

SEQ ID NO: 13003 - DNA, 201 bp, Homo sapiens; identical to SEQ ID NO: 12860

SEQ ID NO: 13004 - DNA, 201 bp, Homo sapiens; identical to SEQ ID NO: 12861

SEQ ID NO: 13005 - DNA, 201 bp, Homo sapiens; identical to SEQ ID NO: 12841

SEQ ID NO: 13006 - DNA, 201 bp, Homo sapiens; identical to SEQ ID NO: 12862

SEQ ID NO: 13007 - DNA, 201 bp, Homo sapiens; identical to SEQ ID NO: 12842

SEQ ID NO: 13008 - DNA, 201 bp, Homo sapiens; identical to SEQ ID NO: 12843

SEQ ID NO: 13009 - DNA, 201 bp, Homo sapiens; identical to SEQ ID NO: 12845

SEQ ID NO: 13010 - DNA, 167 bp, Homo sapiens; identical to SEQ ID NO: 12964

SEQ ID NO: 13011 - DNA, 201 bp, Homo sapiens; identical to SEQ ID NO: 12846

SEQ ID NO: 13012 - DNA, 201 bp, Homo sapiens; identical to SEQ ID NO: 12866

SEQ ID NO: 13013 - DNA, 201 bp, Homo sapiens; identical to SEQ ID NO: 12847

SEQ ID NO: 13014 - DNA, 201 bp, Homo sapiens
tatgccgaggccaactggaactacaacaccaacatcaccacagagaccagcaagattctggtgggagccacctccccacccccaaacctgagcatgtgcabacacacagagatgctgtcccgctcaccacacagtggggctgccaccacattttaaattgaatatttaaaacaatactcaatttcgggccgggcgcggtgg

SEQ ID NO: 13015 - DNA, 152 bp, Homo sapiens
atttcgggccgggcgcggtggctcacgcctgtaatcccagcactttgggagggggaggcgggcggatcacgaggtcagatcaagaccatcctggctaacayggtgaaaccccatctctagtaaaaatacaaaaattagccgggtgtggtggc

SEQ ID NO: 13016 - DNA, 201 bp, Homo sapiens; identical to SEQ ID NO: 12850

SEQ ID NO: 13017 - DNA, 201 bp, Homo sapiens; identical to SEQ ID NO: 12867

SEQ ID NO: 13018 - DNA, 201 bp, Homo sapiens; identical to SEQ ID NO: 12849

SEQ ID NO: 13019 - DNA, 201 bp, Homo sapiens; identical to SEQ ID NO: 12868

SEQ ID NO: 13020 - DNA, 201 bp, Homo sapiens; identical to SEQ ID NO: 12869

SEQ ID NO: 13021 - DNA, 201 bp, Homo sapiens; identical to SEQ ID NO: 12872

SEQ ID NO: 13022 - DNA, 119 bp, Homo sapiens; identical to SEQ ID NO: 12992

SEQ ID NO: 13023 - DNA, 201 bp, Homo sapiens; identical to SEQ ID NO: 12876

SEQ ID NO: 13024 - DNA, 201 bp, Homo sapiens; identical to SEQ ID NO: 12878

SEQ ID NO: 13025 - DNA, 201 bp, Homo sapiens; identical to SEQ ID NO: 12853

SEQ ID NO: 13026 - DNA, 201 bp, Homo sapiens; identical to SEQ ID NO: 12880

SEQ ID NO: 13027 - DNA, 201 bp, Homo sapiens; identical to SEQ ID NO: 12858

SEQ ID NO: 13028 - DNA, 201 bp, Homo sapiens; identical to SEQ ID NO: 12859

SEQ ID NO: 13029 - DNA, 201 bp, Homo sapiens; identical to SEQ ID NO: 12818

SEQ ID NO: 13030 - DNA, 201 bp, Homo sapiens; identical to SEQ ID NO: 12813

SEQ ID NO: 13031 - DNA, 201 bp, Homo sapiens; identical to SEQ ID NO: 12820

SEQ ID NO: 13032 - DNA, 201 bp, Homo sapiens; identical to SEQ ID NO: 12815

SEQ ID NO: 13033 - DNA, 201 bp, Homo sapiens; identical to SEQ ID NO: 12823

SEQ ID NO: 13034 - DNA, 201 bp, Homo sapiens; identical to SEQ ID NO: 12826

SEQ ID NO: 13035 - DNA, 201 bp, Homo sapiens
gtcatggcatctgccatgcgatgtgcacctcagaactgctgagagggcagcgctccccagctccctggctccccacctgccagcccatggggcctgggggyagtgcaggccccagagagaccaagtgcaaaggagtacagctcattgcctctccttcctcctgcagtacaacaagatcctgttggatatggaaaccaccta

SEQ ID NO: 13036 - DNA, 201 bp, Homo sapiens; identical to SEQ ID NO: 12816

SEQ ID NO: 13037 - DNA, 201 bp, Homo sapiens; identical to SEQ ID NO: 12831

SEQ ID NO: 13038 - DNA, 201 bp, Homo sapiens; identical to SEQ ID NO: 12807

SEQ ID NO: 13039 - DNA, 201 bp, Homo sapiens; identical to SEQ ID NO: 12808

SEQ ID NO: 13040 - DNA, 201 bp, Homo sapiens; identical to SEQ ID NO: 12809

SEQ ID NO: 13041 - DNA, 168 bp, Homo sapiens
cttcctcgttgtatcaagtcatggcatctgccatgcgatgtgcacctcagaactgctgagagggcagygctccccagctccctggctccccacctgccagcccatggggcctgggggtagtgcaggccccagagagaccaagtgcaaaggagtacagctcattgcctc

SEQ ID NO: 13042 - DNA, 201 bp, Homo sapiens; identical to SEQ ID NO: 12810

SEQ ID NO: 13043 - DNA, 201 bp, Homo sapiens; identical to SEQ ID NO: 12812

SEQ ID NO: 13044 - DNA, 201 bp, Homo sapiens; identical to SEQ ID NO: 12814

SEQ ID NO: 13045 - DNA, 167 bp, Homo sapiens
cttcctcgttgtatcaagtcatggcatctgccatgcgatgtgcacctcagaactgctgagagggcakcgctccccagctccctggctccccacctgccagcccatggggcctgggggtagtgcaggccccagagagaccaagtgcaaaggagtacagctcattgcct

SEQ ID NO: 13046 - DNA, 201 bp, Homo sapiens; identical to SEQ ID NO: 12839

SEQ ID NO: 13047 - DNA, 201 bp, Homo sapiens; identical to SEQ ID NO: 12817

SEQ ID NO: 13048 - DNA, 201 bp, Homo sapiens; identical to SEQ ID NO: 12841

SEQ ID NO: 13049 - DNA, 201 bp, Homo sapiens; identical to SEQ ID NO: 12842

SEQ ID NO: 13050 - DNA, 201 bp, Homo sapiens; identical to SEQ ID NO: 12843

SEQ ID NO: 13051 - DNA, 201 bp, Homo sapiens; identical to SEQ ID NO: 12813

SEQ ID NO: 13052 - DNA, 201 bp, Homo sapiens; identical to SEQ ID NO: 12845

SEQ ID NO: 13053 - DNA, 201 bp, Homo sapiens; identical to SEQ ID NO: 12846

SEQ ID NO: 13054 - DNA, 201 bp, Homo sapiens; identical to SEQ ID NO: 12847

SEQ ID NO: 13055 - DNA, 201 bp, Homo sapiens; identical to SEQ ID NO: 12823

SEQ ID NO: 13056 - DNA, 201 bp, Homo sapiens; identical to SEQ ID NO: 12849

SEQ ID NO: 13057 - DNA, 201 bp, Homo sapiens; identical to SEQ ID NO: 12850

SEQ ID NO: 13058 - DNA, 201 bp, Homo sapiens; identical to SEQ ID NO: 12825

SEQ ID NO: 13059 - DNA, 201 bp, Homo sapiens; identical to SEQ ID NO: 12807

SEQ ID NO: 13060 - DNA, 201 bp, Homo sapiens; identical to SEQ ID NO: 12853

SEQ ID NO: 13061 - DNA, 201 bp, Homo sapiens; identical to SEQ ID NO: 12812

SEQ ID NO: 13062 - DNA, 201 bp, Homo sapiens; identical to SEQ ID NO: 12837

SEQ ID NO: 13063 - DNA, 168 bp, Homo sapiens
cggggcccgagcgccgggctgcgcgcacggcctacgctcccagcatgcacgagttggatggatgaggstggctgctcccaggccgcgcccgccttcgccgaaggtgctgggcttggctctggggcccccgcgctctcgggcagctgccttctcacctccggacgctgt

SEQ ID NO: 13064 - DNA, 201 bp, Homo sapiens; identical to SEQ ID NO: 12858

SEQ ID NO: 13065 - DNA, 201 bp, Homo sapiens; identical to SEQ ID NO: 12859

SEQ ID NO: 13066 - DNA, 201 bp, Homo sapiens; identical to SEQ ID NO: 12860

SEQ ID NO: 13067 - DNA, 201 bp, Homo sapiens; identical to SEQ ID NO: 12861

SEQ ID NO: 13068 - DNA, 201 bp, Homo sapiens; identical to SEQ ID NO: 12862

SEQ ID NO: 13069 - DNA, 201 bp, Homo sapiens; identical to SEQ ID NO: 12818

SEQ ID NO: 13070 - DNA, 201 bp, Homo sapiens; identical to SEQ ID NO: 12820

SEQ ID NO: 13071 - DNA, 201 bp, Homo sapiens; identical to SEQ ID NO: 12815

SEQ ID NO: 13072 - DNA, 201 bp, Homo sapiens; identical to SEQ ID NO: 12866

SEQ ID NO: 13073 - DNA, 201 bp, Homo sapiens; identical to SEQ ID NO: 12867

SEQ ID NO: 13074 - DNA, 201 bp, Homo sapiens; identical to SEQ ID NO: 12868

SEQ ID NO: 13075 - DNA, 201 bp, Homo sapiens; identical to SEQ ID NO: 12869

SEQ ID NO: 13076 - DNA, 201 bp, Homo sapiens; identical to SEQ ID NO: 12826

SEQ ID NO: 13077 - DNA, 201 bp, Homo sapiens; identical to SEQ ID NO: 12816

SEQ ID NO: 13078 - DNA, 201 bp, Homo sapiens; identical to SEQ ID NO: 12872

SEQ ID NO: 13079 - DNA, 201 bp, Homo sapiens; identical to SEQ ID NO: 12831

SEQ ID NO: 13080 - DNA, 201 bp, Homo sapiens; identical to SEQ ID NO: 12808

SEQ ID NO: 13081 - DNA, 201 bp, Homo sapiens; identical to SEQ ID NO: 12809

SEQ ID NO: 13082 - DNA, 201 bp, Homo sapiens; identical to SEQ ID NO: 12876

SEQ ID NO: 13083 - DNA, 201 bp, Homo sapiens; identical to SEQ ID NO: 12810

SEQ ID NO: 13084 - DNA, 201 bp, Homo sapiens; identical to SEQ ID NO: 12878

SEQ ID NO: 13085 - DNA, 201 bp, Homo sapiens; identical to SEQ ID NO: 12814

SEQ ID NO: 13086 - DNA, 201 bp, Homo sapiens; identical to SEQ ID NO: 12880

SEQ ID NO: 13087 - DNA, 201 bp, Homo sapiens; identical to SEQ ID NO: 12839

SEQ ID NO: 13088 - DNA, 201 bp, Homo sapiens; identical to SEQ ID NO: 12817

SEQ ID NO: 13089 - DNA, 201 bp, Homo sapiens
ccgcttcctctataaagggacctgagcgtccgggcccaggggctccgcacagcaggttctccccatgacaccacctgaacgtctcttcctcccaagggtgygtggcaccaccctacacctcctccttctggggctgctgctggttctgctgcctggggcccaggggctccctggtgttggcctcacaccttcagctgccca

SEQ ID NO: 13090 - DNA, 201 bp, Homo sapiens
gttctgctgcctggggcccaggggctccctggtgttggcctcacaccttcagctgcccagactgcccgtcagcaccccaagatgcatcttgcccacagcamcctcaaacctgctgctcacctcattggagaccccagcaagcagaactcactgctctggagagcaaacacggaccgtgccttcctccaggatggtttctcc

SEQ ID NO: 13091 - DNA, 201 bp, Homo sapiens
tgtctggctgaggatttcaagcctgcctaggaattcccagcccaaagctgttggtctgtcccaccagctaggtggggcctagatccacacacagaggaagrgcaggcacatggaggagcttgggggatgactagaggcagggaggggactatttatgaaggcaaaaaaattaaattatttatttatggaggatggagagag

SEQ ID NO: 13092 - DNA, 201 bp, Homo sapiens
ccaccagctaggtggggcctagatccacacacagaggaagagcaggcacatggaggagcttgggggatgactagaggcagggaggggactatttatgaagkcaaaaaaattaaattatttatttatggaggatggagagaggggaataatagaagaacatccaaggagaaacagagacaggcccaagagatgaagagtgag

SEQ ID NO: 13093 - DNA, 201 bp, Homo sapiens
cacctcctccttctggggctgctgctggttctgctgcctggggcccaggggctccctggtgttggcctcacaccttcagctgcccagactgcccgtcagcmccccaagatgcatcttgcccacagcaccctcaaacctgctgctcacctcattggagaccccagcaagcagaactcactgctctggagagcaaacacggac

SEQ ID NO: 13094 - DNA, 201 bp, Homo sapiens
cccgggccccagccccgacctagaacccgcccgctgcctgccacgctgccactgccgcttcctctataaagggacctgagcgtccgggcccaggggctccrcacagcaggttctccccatgacaccacctgaacgtctcttcctcccaagggtgtgtggcaccaccctacacctcctccttctggggctgctgctggttct

SEQ ID NO: 13095 - DNA, 201 bp, Homo sapiens
aggtggggcctagatccacacacagaggaagagcaggcacatggaggagcttgggggatgactagaggcagggaggggactatttatgaaggcaaaaaaawtaaattatttatttatggaggatggagagaggggaataatagaagaacatccaaggagaaacagagacaggcccaagagatgaagagtgagagggcatgc

SEQ ID NO: 13096 - DNA, 201 bp, Homo sapiens
atttatggaggatggagagaggggaataatagaagaacatccaaggagaaacagagacaggcccaagagatgaagagtgagagggcatgcgcacaaggctsaccaagagagaaagaagtaggcatgagggatcacagggccccagaaggcagggaaaggctctgaaagccagctgccgaccagagccccacacggaggcat

SEQ ID NO: 13097 - DNA, 201 bp, Homo sapiens
tcctccttctggggctgctgctggttctgctgcctggggcccaggggctccctggtgttggcctcacaccttcagctgcccagactgcccgtcagcacccyaagatgcatcttgcccacagcaccctcaaacctgctgctcacctcattggagaccccagcaagcagaactcactgctctggagagcaaacacggaccgtg

SEQ ID NO: 13098 - DNA, 176 bp, Homo sapiens
gctccgcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggttctccccatgacacca

SEQ ID NO: 13099 - DNA, 201 bp, Homo sapiens
cggtccctcctgcacctgctgcctggatccccggcctgcctgggcctgggccttggttctccccatgacaccacctgaacgtctcttcctcccaagggtgygtggcaccaccctacacctcctccttctggggctgctgctggttctgctgcctggggcccaggggctccctggtgttggcctcacaccttcagctgccca

SEQ ID NO: 13100 - DNA, 201 bp, Homo sapiens; identical to SEQ ID NO: 13090

SEQ ID NO: 13101 - DNA, 201 bp, Homo sapiens; identical to SEQ ID NO: 13091

SEQ ID NO: 13102 - DNA, 201 bp, Homo sapiens; identical to SEQ ID NO: 13092

SEQ ID NO: 13103 - DNA, 201 bp, Homo sapiens; identical to SEQ ID NO: 13095

SEQ ID NO: 13104 - DNA, 201 bp, Homo sapiens; identical to SEQ ID NO: 13093

SEQ ID NO: 13105 - DNA, 106 bp, Homo sapiens
gctccrcacagcaggtgaggctctcctgccccatctccttgggctgcccgtgcttcgtgctttggactaccgcccagcagtgtcctgccctctgcctgggcctcgg

SEQ ID NO: 13106 - DNA, 201 bp, Homo sapiens; identical to SEQ ID NO: 13096

SEQ ID NO: 13107 - DNA, 177 bp, Homo sapiens
gctccgcacagcaggtgaggctctcctgccccatctccttgggctgcccgtgcttcgtgctttggactaccgcccarcagtgtcctgccctctgcctgggcctcggtccctcctgcacctgctgcctggatccccggcctgcctgggcctgggccttggttctccccatgacaccac

SEQ ID NO: 13108 - DNA, 201 bp, Homo sapiens; identical to SEQ ID NO: 13097

SEQ ID NO: 13109 - DNA, 201 bp, Homo sapiens
ccatgctgggtgtgttcctggtctccgcagtggcccatgagtatatcttctgcttcgtcctggggttcttctatcccgtcatgctgatactcttccttgtyattggaggaatgttgaacttcatgatgcatgaccagcgcaccggcccggcatggaacgtgctgatgtggaccatgctgtttctaggccagggaatccagg

SEQ ID NO: 13110 - DNA, 201 bp, Homo sapiens
actgcgaaggaaggaggcaacacgggcaagggctgcctgctgcccgctggagaccgcaccatggagccaggcggggcccgtctgcgtctgcagaggacagragggctgggaggggagcgggagcgccaaccctgtggagatggaaacactgagacgcacagagccccggacttggtacaatggacccgacacatggaggct

SEQ ID NO: 13111 - DNA, 201 bp, Homo sapiens
ggatgttctaccgggactggtggaactcaacgtccttctccaactactaccgcacttggaacgtggtggtccatgactggctgtacagctacgtgtatcasgatgggctgcggctccttggtgcccgggcccgaggggtagccatgctgggtgtgttcctggtctccgcagtggcccatgagtatatcttctgcttcgtcc

SEQ ID NO: 13112 - DNA, 201 bp, Homo sapiens
atcttggtcctgccatacctagaggtcgggacagacgacgctacctgcccagacaccaccaagttctctgcctgcaaaacctgggaccaggactcctgtcygcattcccaaatttggctctgagtcgaggcaacctgcacacaagaccccaccaaggaatgtgcaaggactgagatctgcagacttgtgggtaactgatca

SEQ ID NO: 13113 - DNA, 107 bp, Homo sapiens
gggggaactcagaggaactggggccaccaaggttggaaaagggtttggttcttgactttgtattccttccaatacagcaataaactttgtctccctttttattcatt

SEQ ID NO: 13114 - DNA, 106 bp, Homo sapiens
ggggaactcagaggaactggggccaccaaggttggaaaagggtttggttcttgactttgtattccttccaatacagcaataaactttgtctccctttttattcatt

SEQ ID NO: 13115 - DNA, 105 bp, Homo sapiens
gggaactcagaggaactggggccaccaaggttggaaaagggtttggttcttgactttgtattccttccaatacagcaataaactttgtctccctttttattcatt

SEQ ID NO: 13116 - DNA, 104 bp, Homo sapiens
ggaactcagaggaactggggccaccaaggttggaaaagggtttggttcttgactttgtattccttccaatacagcaataaactttgtctccctttttattcatt

SEQ ID NO: 13117 - DNA, 201 bp, Homo sapiens
ggtgcccatgtttctgtccaccctgttggcgccgtaccaggccctacggctgtgggccaggggcacctggacgcaggcgacgggcctgggctgtgcgctgytagccgcccacgccgtggtgctctgcgcgctgccggtccacgtggccgtggagcatcagctcccgccggcctcccgttgtgtcctggtcttcgagcaggt

SEQ ID NO: 13118 - DNA, 201 bp, Homo sapiens
gagcccttcagcacccgtgccctggtgctctctatcctgcatgccacgttgccaggcatcttcatgctgctgctcatcttctttgccttcctccattgctrgctcaacgcctttgccgagatgctacgatttggagacaggatgttctaccgggactggtggaactcaacgtccttctccaactactaccgcacttggaac

SEQ ID NO: 13119 - DNA, 201 bp, Homo sapiens
tgctacgatttggagacaggatgttctaccgggactggtggaactcaacgtccttctccaactactaccgcacttggaacgtggtggtccatgactggctstacagctacgtgtatcaggatgggctgcggctccttggtgcccgggcccgaggggtagccatgctgggtgtgttcctggtctccgcagtggcccatgagt

SEQ ID NO: 13120 - DNA, 201 bp, Homo sapiens
gagccccggacttggtacaatggacccgacacatggaggctgtgaaggcacaattgctggagcaagcgcagggacaactgagggagctgctggatcgggcyatgcgggaggctatacaatcctacccatcacaagacaaacctctgcccccacctcccccaggttccttgagcaggacccaggagccatccctggggaaac

SEQ ID NO: 13121 - DNA, 201 bp, Homo sapiens
gggtgcccatgtttctgtccaccctgttggcgccgtaccaggccctacggctgtgggccaggggcacctggacgcaggcgacgggcctgggctgtgcgctkctagccgcccacgccgtggtgctctgcgcgctgccggtccacgtggccgtggagcatcagctcccgccggcctcccgttgtgtcctggtcttcgagcagg

SEQ ID NO: 13122 - DNA, 201 bp, Homo sapiens
gagcatcagctcccgccggcctcccgttgtgtcctggtcttcgagcaggttaggttcctgatgaaaagctactccttcctgagagaggctgtgcctgggayccttcgtgccagacgaggtgaggggatccaggcccccagtttctccagctacctctacttcctcttctgcccaacactcatctacagggagacttaccct

SEQ ID NO: 13123 - DNA, 201 bp, Homo sapiens
ggtccatgactggctgtacagctacgtgtatcaggatgggctgcggctccttggtgcccgggcccgaggggtagccatgctgggtgtgttcctggtctccdcagtggcccatgagtatatcttctgcttcgtcctggggttcttctatcccgtcatgctgatactcttccttgtcattggaggaatgttgaacttcatgat

SEQ ID NO: 13124 - DNA, 191 bp, Homo sapiens
ataaaagaggattttcccaccttgacaccaggcaatgtagttagcatattttatgtaccatggttatatgattaatcttgggacaaagaattttatagaawtttttaaacatctgattatgctttaatgctgttatctatcttattgttcttgaaaatacctgcattttttggtatcatgttcaaccaaca

SEQ ID NO: 13125 - DNA, 151 bp, Homo sapiens
ttagcatattttatgtaccatggttatatgattaatcttgggacaaagaattttatagaaatttttaaacatctgattatgctttaatgctgttatctatyttattgttcttgaaaatacctgcattttttggtatcatgttcaaccaaca

SEQ ID NO: 13126 - DNA, 201 bp, Homo sapiens
tcccccgtctgaggactgacctttttccaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaacctta

SEQ ID NO: 13127 - DNA, 201 bp, Homo sapiens
aagttggtcatgatgcagaagctactcaaatgcagtcggcttgtcctggctcttgccctcatcctggttctggaatcctcagttcaaggttatcctacgcrgagagccaggtaccaatgggtgcgctgcaatccagacagtaattctgcaaactgccttgaagaaaaaggaccaatgttcgaactacttccaggtgaatcc

SEQ ID NO: 13128 - DNA, 201 bp, Homo sapiens
attcccatggccataaaatggctttaaagaatatatatatatttttaaagtagcttgagaagcaaattggcaggtaatatttcatacctaaattaagactytgacttggattgtgaattataatgatatgccccttttcttataaaaacaaaaaaaaaaataatgaaacacagtgaatttgtagagtgggggtatttgaca

SEQ ID NO: 13129 - DNA, 201 bp, Homo sapiens
ataaaagaggattttcccaccttgacaccaggcaatgtagttagcatattttatgtaccatggttatatgattaatcttgggacaaagaattttatagaawtttttaaacatctgaaaaagaagcttaagttttatcatccttttttttctcatgaattcttaaaggattatgctttaatgctgttatctatcttattgtt

SEQ ID NO: 13130 - DNA, 201 bp, Homo sapiens
atgaaacacagtgaatttgtagagtgggggtatttgacatattttacagggtggagtgtactatatactattacctttgaatgtgtttgcagagctagtgkatgtgtttgtctacaagtatgattgctgttacataacaccccaaattaactcccaaattaaaacacagttgtgctgtcaatacctcatactgctttacct

SEQ ID NO: 13131 - DNA, 201 bp, Homo sapiens
ttatagaaatttttaaacatctgaaaaagaagcttaagttttatcatccttttttttctcatgaattcttaaaggattatgctttaatgctgttatctatyttattgttcttgaaaatacctgcattttttggtatcatgttcaaccaacatcattatgaaattaattagattcccatggccataaaatggctttaaagaa

SEQ ID NO: 13132 - DNA, 201 bp, Homo sapiens
tttgacatattttacagggtggagtgtactatatactattacctttgaatgtgtttgcagagctagtggatgtgtttgtctacaagtatgattgctgttamataacaccccaaattaactcccaaattaaaacacagttgtgctgtcaatacctcatactgctttacctttttttcctggatatctgtgtattttcaaatg

SEQ ID NO: 13133 - DNA, 201 bp, Homo sapiens; identical to SEQ ID NO: 13127

SEQ ID NO: 13134 - DNA, 201 bp, Homo sapiens; identical to SEQ ID NO: 13126

SEQ ID NO: 13135 - DNA, 201 bp, Homo sapiens
agagtgggggtatttgacatattttacagggtggagtgtactatatactattacctttgaatgtgtttgcagagctagtggatgtgtttgtctacaagtawgattgctgttacataacaccccaaattaactcccaaattaaaacacagttgtgctgtcaatacctcatactgctttacctttttttcctggatatctgtg

SEQ ID NO: 13136 - DNA, 201 bp, Homo sapiens
tggtgacccccggggaaactccatcctggactggctcaggcttcgtgcggctacaggaaggtcagaccctggagttcctggtggcctctgtgccgaaggckatggactatgacctgctgctgcgcttagagccccaggtccctgagcaatgggcagagttggaactgattgtgcagcgtccagggcctgtgcctgcccaca

SEQ ID NO: 13137 - DNA, 201 bp, Homo sapiens
gtatccctgcggtcaccatccagctggacctggaggctgagtttcatttcacacacctcattatgaccttcaagacatttcgccctgctgccatgctggtsgaacgctcagcagactttggccgcacctggcatgtgtaccgatatttctcctatgactgtggggctgacttcccaggagtcccactagcacccccacggc

SEQ ID NO: 13138 - DNA, 201 bp, Homo sapiens
gggtgatcagtaccagacggtgaaggccctagctgagcgcaaggcccaaggtgtgctggctgcacaggcaagggcagaacaactgcgggatgaggctcggracctgttgcaagccgctcaggacaagctgcagcggctacaggaattggaaggcacctatgaggaaaatgagcgggcactggagagtaaggcagcccagtt

SEQ ID NO: 13139 - DNA, 201 bp, Homo sapiens
gtgccactgccgggcaggctatacggggctgcgatgtgaagcttgtgcccctgggcactttggggacccatcaaggccaggtggccggtgccaactgtgtragtgcagtgggaacattgacccaatggatcctgatgcctgtgacccccacacggggcaatgcctgcgctgtttacaccacacagagggtccacactgtgc

SEQ ID NO: 13140 - DNA, 201 bp, Homo sapiens
cgtggccagtggggattccctagctgccggccatgtgtctgcaatgggcatgcagatgagtgcaacacccacacaggcgcttgcctgggctgccgtgatcwcacagggggtgagcactgtgaaaggtgcattgctggtttccacggggacccacggctgccatatgggggccagtgccggccctgtccctgtcctgaaggc

SEQ ID NO: 13141 - DNA, 201 bp, Homo sapiens
ttgctacttcttgccaccaggatgaatattcccagcagattgtgtgccactgccgggcaggctatacggggctgcgatgtgaagcttgtgcccctgggcastttggggacccatcaaggccaggtggccggtgccaactgtgtgagtgcagtgggaacattgacccaatggatcctgatgcctgtgacccccacacggggc

SEQ ID NO: 13142 - DNA, 201 bp, Homo sapiens
gattgcagagcgagtccggagcctggcagatgtggatgcgatcctggcacgtactgtaggagatgtgcgtcgtgccgagcagctactgcaggatgcacggygggcaaggagctgggctgaggatgagaaacagaaggcagagacagtacaggcagcactggaggaggcccagcgggcacagggtattgcccagggtgccat

SEQ ID NO: 13143 - DNA, 201 bp, Homo sapiens
gggaaagagggaggggacagcctctgccctgggaacttcgactgggcctactgctaagcgtgctggctgccacactggcacaggcccctgccccggatgtscctggctgttccaggggaagctgctaccccgccacgggcgacctgctggtgggccgagctgacagactgactgcctcatccacttgtggcctgaatggcc

SEQ ID NO: 13144 - DNA, 201 bp, Homo sapiens
cccctgggcactttggggacccatcaaggccaggtggccggtgccaactgtgtgagtgcagtgggaacattgacccaatggatcctgatgcctgtgacccmcacacggggcaatgcctgcgctgtttacaccacacagagggtccacactgtgcccactgcaagcctggcttccatgggcaggctgcccgacagagctgtc

SEQ ID NO: 13145 - DNA, 201 bp, Homo sapiens
cctggctgttccaggggaagctgctaccccgccacgggcgacctgctggtgggccgagctgacagactgactgcctcatccacttgtggcctgaatggccsccagccctactgcatcgtcagtcacctgcaggacgaaaagaagtgcttcctttgtgactcccggcgccccttctctgctagagacaacccacacagccat

SEQ ID NO: 13146 - DNA, 201 bp, Homo sapiens
cctgccacccaagccgggccagaggccccacctgcaacgagttcacagggcagtgccactgccgtgccggctttggagggcggacttgttctgagtgccargagctccactggggagaccctgggttgcagtgccatgcctgtgattgtgactctcgtggaatagatacacctcagtgtcaccgcttcacaggtcactgca

SEQ ID NO: 13147 - DNA, 201 bp, Homo sapiens
ggcccccagccctactgcatcgtcagtcacctgcaggacgaaaagaagtgcttcctttgtgactcccggcgccccttctctgctagagacaacccacacasccatcgcatccagaatgtagtcaccagctttgcaccacagcggcgggcagcctggtggcagtcagagaatggtatccctgcggtcaccatccagctggac

SEQ ID NO: 13148 - DNA, 201 bp, Homo sapiens
cctccactgcacagcttgtggaggccacagaggagctgcggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgact

SEQ ID NO: 13149 - DNA, 201 bp, Homo sapiens
cctcattatgaccttcaagacatttcgccctgctgccatgctggtggaacgctcagcagactttggccgcacctggcatgtgtaccgatatttctcctatsactgtggggctgacttcccaggagtcccactagcacccccacggcactgggatgatgtagtctgtgagtcccgctactcagagattgagccatccactga

SEQ ID NO: 13150 - DNA, 201 bp, Homo sapiens
ccatgtcagtgcaaccctcaaggttcactgagttctgagtgcaaccctcatggtggtcagtgcctgtgcaagcctggagtggttgggcgccgctgtgacckctgtgcccctggctactatggctttggccccacaggctgtcaagcctgccagtgcagccacgagggggcactcagcagtctctgtgaaaagaccagtggg

SEQ ID NO: 13151 - DNA, 201 bp, Homo sapiens
gtgattgtgaccccatgggttctcaagacggtggtcgctgtgattcccatgatgaccctgcactgggactggtctccggccagtgtcgctgcaaagaacaygtggtgggcactcgctgccagcaatgccgtgatggcttctttgggctcagcatcagtgaccgtctgggctgccggcgatgtcaatgtaatgcacggggca

SEQ ID NO: 13152 - DNA, 142 bp, Homo sapiens
agggaccgctggacagacctgggaactgacagagggcctggwgggaaacaggccaaagacccacaggatggagctgacctcaagggaaagagggaggggacagcctctgccctgggaacttcgactgggcctactgctaagc

SEQ ID NO: 13153 - DNA, 201 bp, Homo sapiens
ttagagccccaggtccctgagcaatgggcagagttggaactgattgtgcagcgtccagggcctgtgcctgcccacagcctgtgtgggcatttggtgcccarggatgatcgcatccaagggactctgcaaccacatgccaggtacttgatatttcctaatcctgtctgccttgagcctggtatctcctacaagctgcatctg

SEQ ID NO: 13154 - DNA, 201 bp, Homo sapiens
tttgggaggctgaggacacccgagggcaggtgctcgatgtggtggagcgcctggtgacccccggggaaactccatcctggactggctcaggcttcgtgcgrctacaggaaggtcagaccctggagttcctggtggcctctgtgccgaaggctatggactatgacctgctgctgcgcttagagccccaggtccctgagcaat

SEQ ID NO: 13155 - DNA, 201 bp, Homo sapiens
gcctggtgacccccggggaaactccatcctggactggctcaggcttcgtgcggctacaggaaggtcagaccctggagttcctggtggcctctgtgccgaasgctatggactatgacctgctgctgcgcttagagccccaggtccctgagcaatgggcagagttggaactgattgtgcagcgtccagggcctgtgcctgccc

SEQ ID NO: 13156 - DNA, 201 bp, Homo sapiens
accaggagggggctgatcctgatagcattgaaatggtggccacacgggtgctagagctctccatcccagcttcagctgagcagatccagcacctggcgggygcgattgcagagcgagtccggagcctggcagatgtggatgcgatcctggcacgtactgtaggagatgtgcgtcgtgccgagcagctactgcaggatgcac

SEQ ID NO: 13157 - DNA, 201 bp, Homo sapiens
cacacagccatcgcatccagaatgtagtcaccagctttgcaccacagcggcgggcagcctggtggcagtcagagaatggtatccctgcggtcaccatccasctggacctggaggctgagtttcatttcacacacctcattatgaccttcaagacatttcgccctgctgccatgctggtggaacgctcagcagactttggcc

SEQ ID NO: 13158 - DNA, 201 bp, Homo sapiens
gaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgca

SEQ ID NO: 13159 - DNA, 125 bp, Homo sapiens
agggaccgctggacagacctgggawctgacagagggcctggagggaaacaggccaaagacccacaggatggagctgacctcaagggaaagagggaggggacagcctctgccctgggaacttcgac

SEQ ID NO: 13160 - DNA, 201 bp, Homo sapiens
caacagtggatcctgttactgcaaacgtctagtgactggacgtggatgtgaccgctgcctgcctggccactggggcctgagccacgacctgctcggctgcygcccctgtgactgcgacgtgggtggtgctttggatccccagtgtgatgagggcacaggtcaatgccactgccgccagcacatggttgggcgacgctgtga

SEQ ID NO: 13161 - DNA, 201 bp, Homo sapiens
tgcccatgcctccccaatgtccagggccctagctgtgaccgctgtgcccccaacttctggaacctcaccagtggccatggttgccagccttgtgcctgccwcccaagccgggccagaggccccacctgcaacgagttcacagggcagtgccactgccgtgccggctttggagggcggacttgttctgagtgccaagagctc

SEQ ID NO: 13162 - DNA, 201 bp, Homo sapiens
cactgccgccagcacatggttgggcgacgctgtgagcaggtgcaacctggctacttccggcccttcctggaccacctaatttgggaggctgaggacacccragggcaggtgctcgatgtggtggagcgcctggtgacccccggggaaactccatcctggactggctcaggcttcgtgcggctacaggaaggtcagaccctg

SEQ ID NO: 13163 - DNA, 201 bp, Homo sapiens
tgcaacctggctacttccggcccttcctggaccacctaatttgggaggctgaggacacccgagggcaggtgctcgatgtggtggagcgcctggtgaccccyggggaaactccatcctggactggctcaggcttcgtgcggctacaggaaggtcagaccctggagttcctggtggcctctgtgccgaaggctatggactatg

SEQ ID NO: 13164 - DNA, 201 bp, Homo sapiens
tgggcatgcagatgagtgcaacacccacacaggcgcttgcctgggctgccgtgatcacacagggggtgagcactgtgaaaggtgcattgctggtttccacrgggacccacggctgccatatgggggccagtgccggccctgtccctgtcctgaaggccctgggagccaacggcactttgctacttcttgccaccaggatga

SEQ ID NO: 13165 - DNA, 201 bp, Homo sapiens; identical to SEQ ID NO: 13136

SEQ ID NO: 13166 - DNA, 201 bp, Homo sapiens; identical to SEQ ID NO: 13137

SEQ ID NO: 13167 - DNA, 201 bp, Homo sapiens; identical to SEQ ID NO: 13138

SEQ ID NO: 13168 - DNA, 201 bp, Homo sapiens; identical to SEQ ID NO: 13139

SEQ ID NO: 13169 - DNA, 201 bp, Homo sapiens; identical to SEQ ID NO: 13140

SEQ ID NO: 13170 - DNA, 201 bp, Homo sapiens; identical to SEQ ID NO: 13141

SEQ ID NO: 13171 - DNA, 201 bp, Homo sapiens; identical to SEQ ID NO: 13142

SEQ ID NO: 13172 - DNA, 201 bp, Homo sapiens; identical to SEQ ID NO: 13143

SEQ ID NO: 13173 - DNA, 201 bp, Homo sapiens; identical to SEQ ID NO: 13144

SEQ ID NO: 13174 - DNA, 201 bp, Homo sapiens; identical to SEQ ID NO: 13145

SEQ ID NO: 13175 - DNA, 201 bp, Homo sapiens; identical to SEQ ID NO: 13146

SEQ ID NO: 13176 - DNA, 201 bp, Homo sapiens; identical to SEQ ID NO: 13147

SEQ ID NO: 13177 - DNA, 201 bp, Homo sapiens; identical to SEQ ID NO: 13148

SEQ ID NO: 13178 - DNA, 201 bp, Homo sapiens; identical to SEQ ID NO: 13149

SEQ ID NO: 13179 - DNA, 201 bp, Homo sapiens; identical to SEQ ID NO: 13150

SEQ ID NO: 13180 - DNA, 201 bp, Homo sapiens; identical to SEQ ID NO: 13151

SEQ ID NO: 13181 - DNA, 201 bp, Homo sapiens
ctttccttcctgccgcgattcccaactttgctcaaagtcgctggactctaagctgtcggagggaccgctggacagacctgggaactgacagagggcctggwgggaaacaggccaaagacccacaggcagagttgacacggaaccccaaagcaaggaggagggctcgggcccgagaccgttcacctccccttatccctgttc

SEQ ID NO: 13182 - DNA, 201 bp, Homo sapiens; identical to SEQ ID NO: 13153

SEQ ID NO: 13183 - DNA, 201 bp, Homo sapiens; identical to SEQ ID NO: 13154

SEQ ID NO: 13184 - DNA, 201 bp, Homo sapiens; identical to SEQ ID NO: 13155

SEQ ID NO: 13185 - DNA, 201 bp, Homo sapiens; identical to SEQ ID NO: 13156

SEQ ID NO: 13186 - DNA, 201 bp, Homo sapiens; identical to SEQ ID NO: 13157

SEQ ID NO: 13187 - DNA, 201 bp, Homo sapiens; identical to SEQ ID NO: 13158

SEQ ID NO: 13188 - DNA, 201 bp, Homo sapiens
ccagaatccgctccggcctttccttcctgccgcgattcccaactttgctcaaagtcgctggactctaagctgtcggagggaccgctggacagacctgggawctgacagagggcctggagggaaacaggccaaagacccacaggcagagttgacacggaaccccaaagcaaggaggagggctcgggcccgagaccgttcacc

SEQ ID NO: 13189 - DNA, 201 bp, Homo sapiens; identical to SEQ ID NO: 13160

SEQ ID NO: 13190 - DNA, 201 bp, Homo sapiens; identical to SEQ ID NO: 13161

SEQ ID NO: 13191 - DNA, 201 bp, Homo sapiens; identical to SEQ ID NO: 13162

SEQ ID NO: 13192 - DNA, 201 bp, Homo sapiens; identical to SEQ ID NO: 13163

SEQ ID NO: 13193 - DNA, 201 bp, Homo sapiens; identical to SEQ ID NO: 13164

SEQ ID NO: 13194 - DNA, 75007 bp, Homo sapiens
  misc_feature (1)...(75007): n = A,T,C or G, or insertion/deletion polymorphism (see Tables 1-2)
ttacatttttgatctaatttttaaaaatgttttaccatgctgcacgttagacagccagggacccttagtaacaaggcacaggagccggtgtgtatccagcccttgctgtgcagtgggcactgtgtggtcatcagcgtgtcactcatagacactcatttaatcctctcaaaatccgtaagacgtagtgacacaaacatctccattttacggtgaggatgtagagccctagagagcctgagtaactgcccctgcatcacgcggctcctgagagttgggagctgggattggaatcccacagtcagattctagaacccataccctggcgccgtagttcagcctctcagcccgaattaccgtcattatcgtaacggctgtagcaggtggcattttttttttttttttttttgagttggagtctcgctctgtcacccaggctggagtacagtggcgcaatctcagctcactgcaagctccccacctcccggattcacgccattctcctgcctcagcttcctgagtagctgggactacaggcgcccgccaccacaccyggstaatttctttttgtatttttagtagaggcggggtttcaccgtgttagccaggatagtctccatctcctgacctcgtgatccacccgcctcggcctcccaaagtgctgggattacaggggtgagccaccgcacccggccaacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccrgagcaggccaccaccagtgctcakgtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactcyggagtctgggattcatcccgtcatttctttcaataaataattatyggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaagcgatccaccctcctcrgcccccctaagtgctgggattacaggcgtgagccaccacacccagccataccaaatattttatttaattgtattggacagcagtagtctaaaatctttacatacatatatttttttaacttgtttaaccttccagccatcccacagggaggcaccatcgtgagccctgttaaggaagacaaatgcagtgtcttaaaataacacagatgtattccctaaacagtttcggaggtcagaagttcaaaatcagttttactgggctaacatcaaagtggtggcagggccggttccttctgggagctccaggagagaaactgtgtcctttttccagcttccagaggccacctggttcctaggctcatggcttcttcctccgtcctcaaagccagcagcatcgcacctgcaaatctctctcctgaggtcatcaggtcacgtcctctcctccatcagatctctgtttctctcttccaagtactcaagtggttacatttagggccccctggatgatccaggataatctcatttcaggatcctaactcaatcccaaagtccctttagtcacataagatcacacattcacagaggccaggcacagtggctcacgccttggggaggacttggggaggctgaggtgggaggatcacttgaagccaggagttcaagactagcttgtccaacacagccagacttcatctcctctaattttattaataaaattaataaaaatgtaaaagggccaggcgcggtggctcacgcatgtaatcccagcactttgggaggctgaggcaggtggatcacctgaggtcaggagttcgagaccagcctggccaacatggcaaaaccccgtctctactaaaaatacaaaaattagctgggcatggtggcgcgtgcctgtaatcccagctactagtggggtgaggcaggaggatcacttgaatctgggagacaggttgcagtgacccgagatcgtgccactgcattccagcctgggcgacagagcgagactccatctcaaaaaaaaaaaaaaaataggtcacatcaaaggtttcagcgattaagacctggatatctatgggggctgttattattgcagccaccccacatgggatgatatgttagaggaaaaccatcgggaaatggtcagacaaggcaagcaggatgcctggaacacccacccagccctgggcaccacggggctggcttggggaaaayggctgcacgcggagcggggcccaggctcgggtcttccagagcaggaggcctctaaccccggggcccagcgtggaacaggagcttccgggcatgagagtgtcagggtgtcctgatactcccgcaggggggacacagggctcccagctgtcccctgcccctcacactctgtttctgcctctcacatctgccctccctccttcccttctctctcatcaggttcctctgcccttgtctcccacccgccctctctccccttccttctctatctgcgaggctttgctctctgccgtgcaagtctgtgccaggcttactttgctgtctgtcactgtgactcakcctccctgtctctcttcctgtgtctccatcatggtctcttgtgcacacaatctcttgggcattctgtttctatttgttgtagcccaagaagacaacattgccttccgagtctccttggggctagcagtggccctgtagccctgtgtgggcagacccaggggacataagcacaggggctgctggggacttctggagaaacatctttcctgaccaaaaaggacagccctggttgtggcagctcctcccctcctcctgccttgactagagatgatggctggagccaagtcaccaccttgtaatgatgaggaaaaagagtaacaaactctcctgacgaccctaaaccggcgaacctagggcagcagctgcctaactgtgggcttttgttcatgggagtaggggaagaataagccccagggcgattatgccactctaaaacatggctttcagccgggcacagtggctcatgcctgtcatcccagcacttcgggaggccgaggcgggcagatcacctgaggtcgggagttcaagaccagcctgaccaacatggagaaaccccgtctccactaaaaatacaaaattagccgggcgtagtggcacatgcctgttaytcccagctactcaggaggttgaggcaggagaatcgcttgaacccgggaggaggaggttgcagtgagccgagatcgagccattgcactccagcctgggcaacaagagcaaaactccgtctcaaaaaaaaaaaaaaaaaaaaaagacttgtttctcatagctaagagttcctgatacagctctgccttaaagaactggcaaattagtgtgcatttgtgtttcaatttcaaataaaatgtttaaggcaaaaaaaaaaagtaaatgttgtatgtcaggggatccccacattactggctttgtgtggagaccatggttcctttgggcttggctcttcctccctgcaccagtgcagggccccaggaacacatctgccacacacggccgccatgtccctctgctgaagctagtcagggtcatcctcactcctcagtgaccctcatgatggctccaccaggtaggtacttttattctccccatttaacaggtgaggacactgaggggcacagggatgtaagttaccttccctaggtccactatctaggaagtggtgggccagggtttggtccatgctgtcagctccttgaccctgcatctataactactaactatactrtggagagcctcatgagctcctgcgaggtgtagaaccttatcccgcaggcggggcagtggcatggtcaggtctaggagtgaaaagatcctgcgatggttggagttgcgggcactgaagaggtgagcctggcgttagggggagcaggggagaccatcttccccctggtgaaatcctgttctaaaattggtgatactcctgccttggcctcccaaagtgctaggattatggcctcatatctatttttaaaaaataagaattcaagctgggtgcggtggctcgcrmctgtaatcccagcactttgggaagccgaggcaggtggatcacttgagttcagcagttcgagccagcctggccaacatggtgaaaccctgtctctactaaaaatacaaaaataattagccgggcgtggtggcagatgcctatgttcccagctactcgggaggctgaggtaggagaatcgcttgaacccaggagacggaggttgcagtgagccgagattgcaccactgcacaccagcctgggcgacaaagagtaagactccatctcaaaaaaaaaaaaaaaaaaattcaaaacccatcgagttgggatgacgcttartgctgggcttcaggaagagtaggcaggagggtagtaygggaggtttctaggagccactcttggaagcggtgctccccacagatgcccgattgcactgactggaactcggtcacatgaccacataactsgctcacatgaccacacctagctgcaaaggtgctgggaaatgtggtaccctgttgggaggccacttctgggcttcaaaccttcactgtgaatggagctcacaggttttctaaaaatggacattaaatgaaccagagttggccctaaggatctgrctcactgcaacctccacctcccaggatgaagcacctgcctcagcctcccgagtagtagctgggattacaggcacaygccaccatrccgagctaatttttgtatttttagtagagaaggtgtttcaccatgttggccaggctggtctcgaactcstgacttcacatgatccgcctgcctcagcctcccaaagtgctaggattacaggcgtaagccaccacgcctggcctcaatatttctttttctgggtatttgagtatgatattatatatgatggttattagacagccagatgcataggaggattagctaatctgttttgaggaatacttatctccaatatagttatataacgacaacattctttttttgaatactggtctcgggtgcctaatgacagaagggtgacatcactaaggaagcctggaaagtcccagccctccacgtgatcccacggatgaaaatagctccgggtgagctctggaacagctgaaaaagctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccragcctccgcaccggattccggagcmcaagctccaccgcgcatgcgcacacgccccagacccaggctcaggcaagccgtgggggcagggagggctgtttcatcccgctggggyggccataaccaagtaccagggattgggtgcaattaaataacaggatttctttttcttttttattttattttattttatttatttatttatttwttttgagacagcatctcgctctgtcgcctaggctggagtgcagtgacgcgatctcggctcackgcaagctccgcctccggggttcaagcgattctcctgcctcaacctcccgagtagctgggattacaggcgcmcaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgragcctcttgcagaggccctaatctctccttataaaaccaatcaggctgggcgcggtggctcacgcctgtaatcccagccctttgggaagaygaggcgggcggatcctgaggtcaggagatcgagatcatcctggctaacacagtgaaaccccgtctcaactaaaaatacaaaaaattagctgggcgtggtggcgggcgcctgtagtcccagctactccggargctgaggcrggagaatggcgtgarcccggraggcggagcttgcagtgagcsgagaytgcrccactgcactccagmctagggcacaaagcgagactccatctcaaaaaaaaataaaataaaataaaccaatcaaaccaaattccaggccaccctcaggaccccactttaacttagtcacccctttaaragcctatgtctggccgagtgcgatgactcatgcctataatcccagcgttttgggaagccaaggtggaaagctctcttgagcctaggagttcaagaccagcctgggtgacataacaagacctgatctctacaaaacataaaaaatttagctggagatggtagcatgtacctgcacttccagctactcgggaggctgaggtgagaggctcgcttgagcccaggaggctgaggctgcagtgagccacgatcacaccactgcactccagcctgggtgacaaagcaagaccctgtctcaaaaagcaaacaacgaaaaagaatcctatgtccaaatacagtcacattctgaggttctgggggttacaagtccaacatatgaatttggaggtggtggggggaagctgattaatttcataaggggggtcttgaaactgccttcgcagaaatgtaagtaatgagagaaagctaacatgactgaccatcttgtttctaacctcacaggctagatttttttttcttattctagtgcagaggccaaaattaccatgagaggaatttaattcatagttaaactttgagacaaagaaaactgacccccagtccttgttgagagattgaagccacattcatttactttttatttatttatttakttttgagacagagtttcactcttgttgcccagactggagtgcaatggcatgatctctgctcactggcacctccacctcctgagttcaagtgattctcctccctcagcctcctgagtagctgggattacaggcgcccgccatcatgcccaggtgacttttgtacttttagtagagataaggtttcaccatgttggccaggctggtctccaactcctgacctcaagtgatcctcccacctcggcctcttaaggtgctgggattacagccatgagccactgtgcctggcctgaagycacattcataagacaaggttagaatcatgaaggtgctggaactttgctaaagaacagtcgtgggttgaagaatgacctgccatyccttagcttccttttctrtatgtgctccagagtcacgtaaccaggggtcgcatgatttataacttccccagctacttctataaataatatcactgtcgtgaaacacagaactcagctttttagtggggtgtggtagctaacacctgtaatccccacttcttgggaggctgaggcaggaggattgcatgagcccrggagaatgagaccagcctgggcaacatagtgagacctcaatctctacaaaaaaattaaaactttgccagacgtggtggtgcatgcctgtagtcccagcaacccaggaggccaaggcaggaggattgcttgagcccaagagttggaggctgcagtgagctatgattgcgccactgtagggaccagccctgcagggtctgtgggtctttctccccatgtgcggagacgagagatcgtagaaataaaaacacaagacaaagagatagaagaaaagacagctgggcctgggggaccactaccaccaagacgcagagaccgatagtggccccaaatgcctggctgcgctgttatttattggataataaggggcagagtaaggagtgtgagtcatctccaatgattgataaggtcatgtgagtcacgtgtccactggacagggagcccttctatgttaggtagccaaggcgtagagagagaggatagcttatgtcattatttcttttatgttcttttcagaaagatcaaagactttaatattttaatactttcactaattctgctactsctatctagagggtgcagccaggtatacagagtggaacaggaaagtgaaacaggagtgtgaccactgaagcacagcatcacagggagatggtcaggcctctggataactgcgggcgggcctgacatcactcaggccctccacaggaggcggtggagcagagtcttccctaactcccccggggaaagggagactccctttcctggtctctaggcactgacgcaaccgctagaccaaggtccgctaggcaatgggcrtcttcccagacgctggcgttaccccaagaccaaggggccctctagtggccctattcgggcatgacagagggctcacacttgtcttctggtcactcttgacctcaagtgatctgactgcctcggcctcccaaagtgctgggattacaggcatgagccactgctcctggcaataatgtttcgttttgtttttrttttaaaaaaaagaaattgtctttgagatagttttcagagtgagcattttggcagaccaagagctaccacctggtcctgagacccgctcccaggaactgactcagctatacaaagatagttttggacacacctgtgatttcatccatagcygatcaattgttccctcagccccttgcccaccaaagtttccttaaaaaaccctagtctcaggycggaygcggtggctcgtgcctgtaatcccagcactttgggaggccaaggcgggtggatcacctgaggtcgggagttcaagcccagcctggccaacatggagaaaccccatctctactaaaaatacaaaaattagcygggcatggtggtgcatgcctgtaatcccagatactcaggaggctgaggcaggagaatcgcttgaacccgggaggcggaggatgcagtgagccgagatcatgccaatgcactccagcctggtcaacaagagggaaacttcatctaaagagagagagacagacagagacagagacagaggcagagaaagagaaagagcgaggaaaaaccctagcctccaaattttcagagagacgcgcttgaaatatttctcccattctcctcgcttggccrcccctgagattattaaactctctctctttgctgcaacacctgctgttygcattgrttttgtctgggcagtggacaaggagaacccatgagcccgtgacagtcccagccctcccccactgtctttgctaagcccaacagtgggcacaggactaagaagagccatttctttggcaggaggactgagaattttctgaccgcagtgcaccatgggaaggtaagtcctcttagagctgaccactatggggaagcagagcatttgtgtaatggaatgcatagtragtgtcaagaggtgagggctgtgacagttcctctcgcttggtggagatagatggaaagagctgaaggttgggcatggtggcccatgcctgtaaccccagcacttttggtggccraggcaagaagatctcttgagccccagagttcgagactagcctgggcaacatggtgaaaccctatctctacaataaaagaaaatatttttaaaaattagccaagcatagtggtacacacctgtagtccaagctacttaggaggctgagacatgaggatcacttgagtcccggtgttcaaggctgcrgtaagctatgattgcaccaccgcactggtggtgggcaacagagcaagaccctgtcttattgttgaaccggggaggtggaggttgcagtgaactgagattgcgccactgcactccagcctgggcaacagagcgagactctgtctcaaaaaaragagagagaragagaaagaaagaaagaaaagaaagaaagaaagacagaaagaaagaaagaaagaaagaagggagggagggagggagggagggagggagggagggaaagarggagggaaggaaggaaggaggaaggaaggaaggatggaaggaagggagggagggagggaggggagggaaggggagggagggagggagggaggkaggtatgtcaccatgttggccaggctggtcttgaactcctgggctcaagtgatccacccacctcaccctcccaaagtgctgggattacaggtgtgagccaccgcgtctggccccaaaattaaccattttgaaaagtgaataattgactggcattcratgcattcacagtgttgtacaaccatcacctctatctagtttcagaatattttcctcaccccaaaaggaaaccatgtacccgtgggctggtggctacctgcttggacagcccagttctaggtcaaattctgtgttttatcccttttycctgtgaattttctggacttctttgtgttttctcctgggaagctctgaagtttccataattcctgggctccagaaagaagaaaaggcggccgtgragagacgaagacttcatgtgctgaaagctctgaagaagctaaggattgagsctgatgaggtaagtgaggggaggagggtgsccccagagatcccagaatcrccccctctgtgcccagkgtccagggcccaactcagccagggagagctggaccgaaggatatgaacttctatgggayagaaatagaaggatatgaacttctatgggacaggcattgcccctgcctaagggagatcctakgtctcctycttctyctcctcctcctttctttttcttttcttttcttysttttttttttttttttttttttgagacaacgtctcgctctgtcacccaggctggaatgcagtggcatgatcttggctcactgcaacctccacctcccaggttcaagctattcccctgcatcagcctgctgagcagctgggattacaggtgtgtgccaccacrcccagctaatttttgtatttttagtagagatggggttttaccacattgaccaggttggtcttgaactcctgacctcaagtgatccacctgcctcggcctcccaatgtgctgggattacaggcgtgagccacggtgcccggccccaggtacccttcttcttgttcccacctccatcctcagsctctaaacctctgatcgattttctccccaatgcctaggccccagttgttgctgtgctgggctcaggcggaggactgcgggctcacattgcctgccttggggtcctgagtgagatgaaagaacagggcctgttggatgccgtcacgtacctcgcaggggtctctggatccacttggtaagcatcactcatgtttcagattgctttctgacacataaatgggattatttttttcctcctgacaccaaatgtgtgtggttttttccaacgctgcttctcgagctctctggtactarctgggtgtcctacaattctgagcaattctgacgctggctacctggagttcrcatcagattccacaggtgaaaggggctcagtcccaaaaaactgctcccacttcagacacgagttgcaattacctagccgctggtgcttctgaccgactggcaatagtttggggtttcccacagcttccgcctcatgttcaataatttactggaatagctcacagaactcaggaacacactttacttacaattgctggtgtattacaaaagatgggccaggtgtggtggctcacgcctgtaatcccagaactttgggaggctgaggcaggaagatcgcttgagtctaggartttgagacccaggckgggcaacatagcaagaccccatctctacaaaaagtgaaaaaattagccaggcgtggtggtgcatgcctatggtcccagctactcaggaagttgaggcaggaggattgctttagcctgggaggctgaggctgcattgagctacaatcacaccactgcacaccagcctgggtgacagagagaccctgtctcaaaaaaaaaawtttttttttctaaaaaagaaaattccaagggttttaggaactctgcaccaggaagcaggggaaaacaccaagtatctttctttgctacacaaagccatggacaaagcataataatactaccttctgacattaaaggaggatttacatgttcaggtgcacttttcacactgcaggtggatagaatacagcccttttaacttatcagcctctatgataaagtattgcattaatccgtgtaggactgtctcattcaggaggccccagatggcaggtatgaaacactcatgtctgcatgtttgttgccaagcccagggcagacatgactaatcgatcttggcacattttcagagcaggaggtaaggctaggcagagcagcagaggctcgagtgtgagataggcagggcagaggcatgaatgttgagcctggctggcctgatttgttttcmtttctgtgctcaaagtttgatctggagctgggttctgagctggatgtggaggatgaggttcmtggaggcgacagcatgaagagcagagctgcagagcttgggagtgggaaaggtcctgcagagtcacaccggacccctctattcctccaaggctcatctaacatgttgagtgacatggcgtgggggtttagcygtactgcacattgcagaactccagggggcgctattgagataggaaccccatgatttcttctggaatctttccgagactgctgtggttaaaaaggcaggcctggctggacacagggactcacacctgtaatcccagtactttgggaggtcgaggtgggaggatctcttgagcccaggagttcaagaccagcctgggcaacatagcaagaccccatctctacaaacaacaacaacgaaagccttatatttcaacagctttgggttagttcctggagctgtcctttgtgggctgttacgagcccagacatacttctttgtgccttggtttcctccgctgttgagcattgtaagtgtggacgatgaagactgggaaaggatgtgtgtgaggaggtccttcacaggaacgcctgcctcatggagagggcgacacacagaggaaatggaaaatttacatgaaataaatataactgcagaacgrtcaagttcaaaggagcactcaaaatcatctgggacagtccttccatttcacaggcaggaaaatgagagcacgatgggagaaaggcctcatcagagtcaaatgttttttgcagccagcatttattaaaggtttacatgtgacagcaacaaactgtgctgatctcacaggrctgtttgagaattaaatgatgaaacacatgcaaatcgtcccaacctgagctatcaagtagagctatgtaacatgagccacatctattctatcattttaaattttctttctttcttttcttttctttttttcttctggagacacagtcttgctcttgtcgcccaggctggagtgcagtggcgcgatcttggctcattgcaacctctacytcccaggttcaagtgattctcctgcctcagcctcccrgttagctgggattacagacgcgtgccaccayrcccagctaatttttgtatttttagtagagacggagtttccccgtgttggccaggctggtctcaaacttctgacctcaggtgatctgcctgccctggcytcccaaagtgctggaattacaggtgtaagccaccatgtcyrgcccattttaaattttctagtagcctcttcaagaaggtaaaaagaaacagtgaaatgatccattttctttaacccaatatatccaaaacattagcattttgacacatcgttaagaaaaaaattgttaatgagatatttgacattccttttgtcagactaggtctttgaaagctgctgggcgttttatactgagcgcattccaagttggatgcagaagtctcattagatgttaaaggaggcccggggcagtggctcacacctgtaatcccagcacttcragaggccgaggcaggtggatcacctgaggtcaggagtttgagaccagcctggccaacayggtgaaaccctgtctctactaaaaatacaaaaattagctgggtgtggtggcacgcacctgtaatcccagctacttgggaggctgaggaaggagaatcacttgaatccgggaggcagaggttgcagtgagccgagctcgaaccactgtacttcagcctgggtgacaagagtgaaactccatctcaaaaaaaaaaaaaaaaagatattaaaggaaagaacttttcatacccagcttgttccaaacatacttcagagtttcccaataactgaatggagtaccagtgtttaaatttaagctaattaaaatgaaataaatattttaaatcatgctagccacacttcaggggctcaagagctatgatgtatgtttaatacattggatggtgtgagggtagatagcaccygataagcagcattaagaacatcaaaaatttttattgagcccgggcacggtggctcacacctataatcccagcattttgggaagctgakgtgggaggattgcttcaggccacaagtttgagaccagcgtgggcaacatagtgagactccatctctacagaaaataaatttaaaaatgagcagggcatggtgatgcacctggtgggtagtggtcccagctacttgggaggctgaggtgggaggatcatttgagcctgsgggtttgagactgcagtgagccaagatcatgccactgcactctagtctgggcaacagagcaagacctgtctcaaaaaaaaaaaaaaawatatatatatatatatatatagactctatgtgacacaccagctcccttgccttctgccatgagtagaagctttttgcaccrtgcttcttgtacagcctgcagaactgtgagctaaataaacctcttttctttataaattaatatatatratatatatttattgagtgaacaaatgaatataaagtcttttttttctttttttttttctttttgagatagagtcttgctctgttgcccaggctggagtgcagtggcgcgatctcggctcactgcaagctcagcctcccgggttcacgccattctcctgcctcagcctctcgagtagctaggactatagtagctgggactgcaaccacacccagctaattttttgtatttttagtagagacggggtttcaccatgttagccaggatggtctcgatctcctgacctcgtgatccgcacaccttggcctcccaaagtgctaggatcacaggcgtgagccaccacgcccagctttttttttttttttttttttttttttagatggagtcatgctctgtcgcccaggctggagtgcagtggcacaatctcagctcactgcaacctccgcctcccgggttcaagcgattcctctgcttcagcctccygagcagctgggaccacaggcgtgtgccaccatgcctggctaatttttgtgtttttagtagagacagggtttcctgagtatccggcactagaggtacccaccaccacgcatgccaycaygcctggctaatttttctgtatttttagtggagacggggtttcaccatgttggccaggctggtctcgaactcctgacctcaggcaatcctcccgcctcgtcctcccaaagtgctgggattacatgcatgaaccaccacacctggccccgttcattgattttctaggattatgtgagttaataggtataaaagactaaagacagtttgttgctgtcacatataaaccttttaataagtgctggctgcaaaaaacatttgactctgatgaggcctttctcccatcgtgctctcattttcctgcctgtgaaatggaaggattgtcccagatgattttgagtcctccttcgaacttgatcrttctgcagttktatttatttaatggaaattttccgtttcctctgtgtgtcgccctctccatgaggcaggtgttcctgtgaaggacctccttgcacacatctttccccagtcttcatcgtccacacttaaaatgcycmactcactctcttcctctgtcctccagggcaatatcttctctctacaccaatgatggtgacatggaagctctcgaggctgacctgaaacatcgatttacccgacaggagtgggacttggctaagagcctacagaaaaccatccaagcagygaggtctgagaattactcyctgaccgacttctgggcctacatgkttrtctctaagcaaaccrgagaagtaagtcattcccagctggggacctggggtgggggtaggagcaaggggtctcagggtgtggggttaccaaagatgctgaccagcaccaccttttaagtccttcaggattttcaagtcatcaaaatctgggcacttcggytgatgcctcaaaactaaagtatatcaggattactgtggttgcaagtgacagaaattgactctgattcgtttatgcaacaaataaagtgataygatttactagaaagatacacagacatccagggcaagaagaacaatgaggacttatgatggaataaggcagaaatagggaaagtgtcagacccaagacaactttcctctccatctctgcttggccatttgatgtcttgaattcactattttattttatttcattttatttttgagacagggtcttgctctgtcacccaggctggagtgcagtggygagatcatggctcactgcagcttcgacctcctgggctcaagcaatcctcttgcctcagccttttgagtaagctggggcaacaggcatgcaccatcrtgcctggctaatttttaattatttttttttttgtagagacagggatcttgctatattgcccaggctggtctcaaactcctgagctcaagcaatcctccaactactgggttcaagtgatcctcctatctcagcctcccgaagtgctgggattacgtgtatgagccactgcatccagcctatcctaacacwtcgggtttttgttgttttttgtttgttttgtttattcttgagacagggtttcactctgtcgyccaggctggagtgcagtggtgcaatcacagctcactgcagccttgacctcctgggctcaagcaatcctcycagctcagcctcccaagtagctgggactacaggcacrcaccactgggcctgacaaatttttttttttttttttttttttttagagatagggtttcgcttttttgctcggggtggtctccaaatcctgggctcaagtgatccttccacctcagcctcccaaagtgctgggattatgggtatgagccactgcacctagcctatccaagcactttgggtggctgaggcgggaggattgcttgaagccatgagttcgagaccagcctgggcaacatagcaagagcctgtctctatcaaaaaataaattagccgggcatggtgacatgcatctgtagtcccagctacttgggaggttgaggygggtggattgcttgagcccaggaggttgaggctgyagtggcccattattgtaccactgcactccagcctgggtgacagactgagacccctctaaaaaaaaaatgtggcctacgtgcagaggttccaccctstgggacccacatgcctccctcacactgtcttggcacmttctcccaaagctgcyggagtctcatttgtccaatatgaagaagcccgtggaagaagggacactaccctacccratatttgcagccattgacaatgacctgcaaccttcctggcaggaggcaagagcaccaggtaagcaaacatttagagggagggagaggtartaagggatggaacrgcacrgagtggaatggaagaatgtttccctgccctccccttggggagcccaggaagagggaagggctcaggattgcagaaaacagggtgctcagcttagacgagagaagagggaagtcccagaagtgaccagaggacatgcacttgctttgcatggatcaagaaaacctttaagaggccaacatggtggctcacgcttgtaatcccagtggtttgggaggctgaggtgggaggatcgcctgaaaccagaagttggagaycaccctgggcaacatagtgagatcccatctcaaaacaacaacattaaaaaacmaaacaaaacaaaaaaacacaataaattagccaagcatggtggcaggaacctgaagaatctacccaggagactggggcaggaggatcactggagcccaggaattcaaggcttcggtgagctstgattgcaccattgyactacagcctgagtgacaaagtgagaccctgtccccccaaaaagaagaaagaaaaaagaaaacagaggagaggagggacaaaagamaaaaaggggccgggcgcagtggctcacgcctgtaatcccaggactttgggaggccgaggcgggtggatcacgaggtcaggagatcaagaccatcctgrctaacacagtgaaaccccgtctctactaaaaatacaaaaaattagctgggcgtggcggcgggcgcctgtagtcccagctgctcgggaggctgaggcaggagaatggcrtgaacccgggaggcggaggttgcagtgagctgagatcgcgccacagcactccagcctgggcgacagagcaagactccgtctcaaaaaaaaaaaaaaaaaaagaaaaaagaaaaaagtaaagaaaactgtaataagggatgtttgaaggatggcggggtgggtgggtggggctgtctctcacttttttttttttttttgagacggagtttctctcttgttgcccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccrattatcacccaaatgctggcagctctccagacattccagtttctcttttgagctcatctctctcctgagatccagacctccttaccctatttcctaagcataaaatgcactcacttgttcagcaactgtgtcctggtaagttctcacgatacatcaggcaatgttaccagttacctgtggttgggcgtctcctggcatctcaaggctcagaagyccccagtgtgaatggtgtttgtctgtttgtttgtttgagacagagttttgctcttgttgcccaggctggagtgtaatggcacgatctcggctcactgcaacctctgcctcccaggttcaagtgattctcctgcctcagcctcccaagtagctgggattataggcatgyrccaccacgcctggctaatttttgtatttttagtagggatggggtgtcaccatgttaatcaggctggtctcgaactcctgaccttaggtgatccactcacctccgcctcccaaagtgctgggattacagacgtgagccaccacgcccggccatgaatgttttatctctctcctcggtgtggatccttgtgctgttttctcaccagagcagatacagctgactccgtcctttccataagccccacaaattcagtcattcccagacctagaaatcaccccctcctcattttcatcctttgtgctcttctacatcayccccagaccaggtctcccagtctcctgggagactcttgtaattagttcctcactggcccgcccatcccaagctgtccacctccttccctggctacctgatggaagtttccaggatgaaaatctgatcatgtcattttcttccctggaatattctaatgactcacattggaatcatgcattagatttatgcccacagacaatcctccatgcaatcgtgtggctacactcttccyttgcactccaggattccatggagttgcagccacaatgagatggaagararaggcagggctgagggttcaagctctggaaaatattggaaacaggctgctgtggaagttatgagctgccaccagcagcgtagactcaggtctgaggatgagatccccagtggtttctgataccacacagtccatctctaacattctcctgtcrtggttgtaattyctcattaatagatttctttttcctgcataccygctacattcctggttctgtgctgggactcacttgccgttgtatttcctctgcagagacctggttcgagttcacccctcaccacgctggcttcyctgcactgggggcctttgtttccataacccacttcggaagcaaattcaagaagggaagactggtcagawctcaccctgagagagacctgactttcctgagaggtcagcgctggggtcagaggggattaaaagggggtgggaagtggaggagaggcaagaattttccttctgagggtctagtttgcccagctcttaaatttcttgggggaaagaaaaggacttggtaggcttccagaaagaggaatggtrtattccttctgctgagtcttcagtgtctctcaaaggtctccttaatgcggcagatacctgatatcctatcaaacaatccaggagagggagcttaatagaggggctcaagtcyagggctgtggcttccaataagcagattcagaatgtgtttgggattacatggtgctttgggaggctgacctgggaggatcccttgagactgggagtttgagaccaacctcggcaacatagcaacactgtgtctctacacaagatttaaaaattagccaggcattgtggcatgtgcctgtggtcccagctactcaggaggctgaggcagtggaaggatcacttcagcatgggagttcaaggctgcagtgagttatgatcgccccactgcactccagcctggatgacagagaaagatcttgtctcaaaacaaacaaacaaacaaacaaacaaacaaaaaactagaatgtgttttgggcaccagcaaagcaaggggcatacaattttttttaaatggggyatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcrttaccctgctgggcagacagctcccctacataggaccaaccatgccagcttgagaaagtcattaatgttacctgagcctcgtttttctcatagggaaagtacttacctcaaaatgtgggtgtgagagttaggtatgatccacaaataaaacactcagcccagtgyccagcacatggtaggaaattaaggatggttgactctccatgattttagcatacacttttgagacacactaggagcctgatactattttaaatgcaggggattcagtcatgagcaggacagtgaaggctcattccctaatgaagtttgcactccagggaaggagatgatgaatgaacacacacamaaataagtatgtattataatgtcagatcatagtaaatgctatcttgaaaaataattcatggtaagggactggagagtgactacagtattatttttaattggtggtcagagcttctgacaggagatggcctttgagcatggacctgatgaaaagtgaagccatgcagatatcttagaggaaaagcatcatggacagagggaagagcaaatgcagagaccctgtattagtccgttttcatactactataaagatactacccragactgggtaatttgtagacaaaggaggtttaattgactcacagtttcacatggctggggaggcctcaggaaacttacaatcatggcagaaggtgaaagggaagmaagaaccttcttcaagtggtakcaggagagagaagagcaagccaaagaagagctgcccaacacttatcaaaccatcrgatctcgtgagaactcactygctatcacgagtacagcatggggggatctgcccccatgatctgattacctcccaccagstctctccctcaacatctggggattacaactcgagagatttgggtggggacataaagcttaaccatatcagaccctaagccrggaccaagtttgtcttactctagaaccaatgagaagaccagtgaggctggagcctcctgaatgaggctgagagagagggctagagaggtaggcagggtccagatcatatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctggaaacctggagatggatgaagaagaattacacctggattggatgtggagagtaaggagaatcagagatgacatcaaaggttccagcttctgcaacctggtagatggaggggtgttctcaggggaggagaacaaggtaggatgaaggggatcttccccttttctctggtctggacagacggggtccttcacattgccaagcctggctcctgtctcctatccccaccatctctttgctaaatctggtcttgggcatcagagattttgaaattgtcactcccaggtactccctataacattattatttccttagatgtatgtatcacctactgaagggattctgtacrtgtattttatccctcccctcacacaccagggtgctttttatttattattataaaataaacataacataaaatttgccattttaaccattttaaagtgtcaagtacagtggtataaatacaatacattcataatgttgtgcaaccatcactgccatccatctccataacacttttcatcttgtaaaactggaactctacgcccattgaatactaagtccctgtcaccccctcccttagcccctgacaaccacaatgctaccttctgcctctacgattttgactactctgagtatgacatgtaaatggaatcatgcagtgcttgtctttttgtgtctgtctgatttcactgaggaaaatgacttcgaagttcatccatgttgtaccatgtgtctgaatttcctttctttttatggctgaatcatattccattgtacgaatataccacattttgcttatcaattcatccatcgatggacacatggattgctttcaccttttggctgttgtgaaggaacctgccatgcacatgggtctatgaatatctctttgagaccctgctttcaattcttttgggtatatactcagwrgtagaattgctggatcatgtatgtggtaattctacttttaaaattttgaggccaggtgtggtggctaatgcctgtaatcccagcactttgggaggccgaggcgggtggatcacctgaggttgggagttggagaccagcctgaccaacatggtgaaaccccatctctacaaaaaatacaaaattagccgggcatggtggtgcatgcctgtaattccagttactcaggaggctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggkttccaatttctccacgtcctcatcaacacttattgttttctggggttttttggataccagccatcctaatgggtgtgtcwttttttttttttttttttttttttttgagatggagtctcactctgtckcccaggctggagygcagttgtgtgatctctgctcactgcarcctcccaggttcaagttattsccctgcckcagcctsccaagtagctgggactataggtgcataccaccaggcctggctaatttttgtwttttttagkagagawagggtttcaccatgttagccaggctgaytttaaactcctgacttcaawtgatccgcccacctcagtctcccaaagtgttagcrttacaggcgtgagccaccgtgcctggctgattattcattttttatgtctccctgtatcatatacaratgtgtttggctaaaagtcactaaccaaccacagtgccccgaggacatgtgggattaattttcttacaaaagaaaaagacagacygrgcaccgtgactcacagctgaaatcccagcactgtgggaggccgaggcgggcagatcacttgaggtcaagagttcaagaccagacgggccaacatggtgaaaccccgtctctacttaaaaaatacaaaaattagcagggcgtggtggygcatgcctgtaatcccagctagtcgggaggctgaagcaggagaatcacttgaatctgggaggcagaggttgcagtgagccgagatcacaccactgmactccagcctgggcaacagagcgagatcccatctcaaaataaataaataatacaaagttaggtggctggtgacattggtttagctgtgcaacattaagcagaaggacccaggtttattctagattttctgctcctccatccttagcatattaagtcaccctcatgctgaactcctccacaccacgggatggcggctgcatccaatgaarctgcaacttttttttwttttttkgaagtcagggtctctctctgtcactcaagctgccgtgcaaaagcacagtcatagcccaatacaggtcttgaactcctggcctcaagtgatcttcctgcctcagcctcccaagtagctgagactagagttgcatgccaccatacctggcctgctccttctgagaaggagaacaagcactttgcagaagtccccccagcagtgtgcatggaccagagcttgaccktcccctagctgcaagggaggctgggaaatatttgcccttcctgcctgtgtgctgagaagggttggcatggacrggagcttgaaatggccttggggtagccagtctacagtgcccggctggctccacccatagaaggttcgtgaggacaaggacyttatctgtcttgtttactgctctattccaacagccagaagagtgccgggtgcccactaattgcttcataaatatttatggaatggaagaawgatctttcttcctgctgcagatccctgcagtgctttatgccagtctgctggtgctttgaatatcaarcatgacagtcacgtgatggagaatgtttgaattttattgctcttttcttggcaggtttatggggaagtgctcttggtaacactgaagtcattagggaatacatttttggtgagtatttggggaacagaamggtcaaascctagagatattttatgcaaggagattcacagtacttttcctactcatggcagaagagagacctgtgtgtaattgttctagcaactgcttttcctgacatttattctcatataattgggcagccaggatgaccacagagtggatgagagtacagactcccttggaaggaatgttgctctggtacatgtaagctttgtgacctccgaaaagttacttaacctctctgtgcctcgktttctgcctctgtgccatgcgggtgataataacagtagttatgaatatttgatgagttaattcattgaaagcttgtaggacagtgcctggtagataacggcactcagtaaacattagcaatcattacctggtcyctcatttaacatttaacccctttaataccctaagaggcagacgcttttgtcccttccattttgctgagatccaccaagtcgtgggaaggrtgcgtgactcacccacactgctggtcagtragtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctgacacatgggagtgtttcattacatgttaatcttatttttaggatcattactgagttcacaccctaaaccactcgtcattcatttaatgtatattcatgggacctcctgtgtgccaggcactgtcctagttcttacactttgactttttttgttgtttgtttttttgagacagagttttgctctgttgcccaggctggagtgcagtggtatgatctcagttcactgcaacctccacctcccaggcttaagcaactctcctcccgagtaactgggactacaggcgcgcaccaccgtgcctggctaatttttgtatttttggtagagacaggatttcaccatgttggccaggctggtcttgaactcctgacctcaagtgattcactgcctcagcctcccagtgtgctaggattacaggcataaaccaccacgccygggctgatgttgttctttgacattggtgttcaccatagcttggttaaaaacaaamctaaaaagggaatctatctatatccaacctccaaatggctractaaaggtgtgagatgggtctgagtgttacttctccagtgggtckgctaagctttctctctaaaaaacaaaaacaaaattcctgatatgtagtgtttgccaattcctgtggtgtaaatgttcccacygtggccaacttcaggctaccaacatgaggtcactgagcacagagttggaagagaggtgcaaaattggctctcgrgagccattggctgccaktggagcccatggctgccatttctattaatgaaatatccctgcaggtcatctrtattttttatattataactagggactttgttgtacagataaacattcctcctgcttctactcttttgcagaccagttaaggaatctgaccctgaaaggtaagcatcctacttcatcatgaatccctgatgataatggggmcygcacacttgcttgaggccagccattgtcctaggaacattacatgtrtgattcatttggtgcccatttgaattctttatctggtatttcaaagatttcatcttgatttggatctgttgctggagaggtagtgtgatcttttgggggtgctgtagaaccatgttttgtcatrttaccaaagttacttttctgattccttctcatttgagtagactatttcttttaattattcttgaatttatgttggatttgactgtgttttttttttcttttttccrcttaaggatgtgactttaatgtccctagctaattatagcctaatttggtccttggtgctttcaggggtgaagattgtaagagttccttggatatagggagtcttcgtgtgatggctttctcatatgctggttgtagaagcgatgtgctcactgtgtgagcaagttcactgttgcctacagggctggaatggtagaagwctcttgaagcttaactcattccccacaaggcatgcaattttttycccagtattttattgactggtttgatggttcaggcttcaggtctgtaggggagtgcataggaagtgaytgtggccaaaacatgtgagtaaatgcaacacccaatggtgagcaaaggtcccagccttgacagaggtggctggaggagctctcagtgagttgcatcgagattttttttttttttttttgagacagagtttggctcttgttgcccaggctggartacaatggcatgatctcagctcaccccacaacctccgcctcccaggttcmaggaattctcctgccgcagcctcctgagtagctgggattrcaggcacttgccaccatgcccagctaattttgtatttttagtagagatggggtttctccgtgttggtcaggctggtctcgatctcccaacctcaggtgatccgcccacctcggcctcccaaagygctgggattacagccgtgagccaccatgcctggctgtgcaccgtggtcttatcaggcagaagggttggagccacctcagctcccctgccaggtcagccagaaagccatccatctctcagacacactcgtgatccagtgctccagctattcagatcagacrggcacctcttttcatctgtaggaatgttggtgttcyragtrgagaggaactgtgaatctgtctcttrtgcaagcctaaacctagaggggctcctcctgyggggatgcagtcrccctgatrtgttccagaaaggctgtctatagttgtacccatgctgagctcccatgggagaaaccccaactgtgcctgtggcartggaagagaggggaaagacatccccttatccaagacccttcaygcacaccagggctgtctgatggttgggttagagctgtgggctttccgtgctgagcccagcactgaaactgtgtccctgctgaaagaaacttcccaccagcagaaagatctgattttcaagkcctgctgtccagattcttttgtcccatggggtgttcccttgatgtggtgcactccccattcccctaggataggagtcactgagcaccagactacagtgagtgttattgttcctctgggtctagccacccagtgaagctgccacacttcaggctggttcytgggaatgtctccaaggaatccrgtaatgtcmcctgtcctcgagactcccagcaatgggaagcagcaccagctctaatgggggtggcaggagagagacacaggctctgtgagattccttgstgatrgacagccttagtaggttggcttccttgaatgctagttatagtagtaatgaactgatcatgtggacagactcaggacctcctggttagccagagtggtgcaygcagtggtgatagctgaggacatagagcyattttctccttcctgggcycagtgttatcctaccaggagatgctgtcatggactgtgttggttggcctccacccagcaggtggagcaccagctgcagtagtagcagtgggatattcacttgccctatgttgcccagggtggctactcttgtttctcaggcaatgggcagagccacagagttcccaaaagyttccgtcctttgtattaaagccaccagggcgggtggcagggcaaagccaggtgtgggctgggtcaggcagttttgtgctctaactctccctgtgcagggcaagcagcagctcctgtgggtatcagggggtgggggtggttttcagacccatgtgctgataatccagagaggaatgtttctgcctctgctgcacagaagagtttgtgtagggagtggggagtggcaggtggcagtaagccccacgcrgatcccacacmcttggcgaggcagatcccytcccaccctgttccactggcagtggtgagctaagttccaggcagcctgtgctcagaacttgcaaatgcccccaagtcataagctttccctgcagagatagcaaccactgctctcaggccatgcccmtccccatctatcccacctagccatgtgccagggtcctgcacacgtgtctgcagcttgcttttcattcaccccatgtgggtggagaagttcacctccacccacagttatctcatgaaacmcagctgggggcttctttcaacctgcgaccacccacctgaactttttggctgaccactgcagggtgccctgtgaggaacaataaggaatggcttccctgggtccatactgggatctgggagtgcatgcagggttcttcccacagctcctacttayattccacgaacctccccaagtcatatcctgcactgaatagggttaaggccttaccccagagactggactttcaggctccctggtgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccrgctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatattttatgcaaggagattcacagtacttttcctgcatgtggcagaaaagaggcctgtgtataatggttctaacaaccacatttcctgacatttattctcatacactgaacattgattatgggcagccasgaagaccacagagtggatgagagtacagacacccttggaaggaatgttgctgtggtacatgtgagctttgtgacctctgaaaagttacctaacctctctgtgcctcagtttctgcctctgtgccatgtgggtgatrataatagtagttatgaggattaaatgagttaattcatcaaaagcacataggacagtgtctggtagataaaggcactcagtaaacattagcaatctggctggatgcagtggctgacacccgtaatcgcaacacttgggaggctaaggcgggcggatcatttgaggccaggagttcaggtttctgatcctggccaacaggtgtgtggagctggtgcctgctacttccaggcctggctacaaaaggccttctgtggctctccagctctctcctctcatggaacagacaaggagaccttgtgccaagaggagaagctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagcyaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacacacaaaattggcattcgttacctgttcatcatttaaccctttgaatgacctgaagaagtggatgctgttgtcccctccattttgctgagagccaccgggtcatggaaaggatgcgtgactcacytatgtaactggttggtgagtgcagacacagggatctataggggaatcgtatggtggttctgatccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcrggagtttgagaccagcctgaccaacgtggagaaaccccatctctactaaaaatacaaaattagccgggcgtggtggtacatgcctgtaatcccagctacacgggargctgaggcaggagaatygcttgaacccaggaggtggaggttgcagtgagctgagatcacaccattgcactccagcctgggcaacaagagtgaaacacagtctcaaaaaaaaaaaaagaaaaaagaaaaagaaaaagaaaaaaaagaaatgaaacaamcaaaaaaaaaaaaaaaaagraaagaaaatcaacaacaacaacaaaattctctgtgacccaatttctcctttgtaaaatggatacaatagtgcatagccccaatcttgtatatttatatcaaataaatgtaaatatacatcaaatatacaagattgggactatgtactatttgatgtggggtttaaatgacctcatgtatgtaaagtacttagagcaaagcttgacacatgggagtgtcctcttaaatgtcaatattatttttattatgtcttgtattgttagaaaaagcaagccagggccaggcgcggtggctcacgcctgtaatcccagcactttgtgggggccgaggcgggtggatcaccaggtcaggagatcgagaccatcctggctaacatggtgaaactccgtctctactaaaaaatacaaaaaattagccgggcgtagtggcgggcgcctgtagtcccagctactcgggaggctgaggcaggagaatggcgtgaacctgggaggcagagtttgcggtgagccaagatcgagccactgcactscagcctgggcgacagagcgagactccgtctcaaaaaaaaaaaaaaaagaaagaaagaaaaagcaagccgggcacagtggctcacgcctgtaatcccagcactttgggaggttgaggtgggtggatcacttgaggtcaggagtccgagaccagcccagccaacatggtgaaacctcgtttctactaaaaatataaaaattaactgggcatggtggcgggcgcctgtaaccccagctactcgggaggctgaagcaggggaattgctcgaacccgggaggcaggggttgcagtgagccgagatcgcaccactatactccaggctgggcaacagatcgagactgtgtctcaaaaaaaaaaaaaaaaaaaaagaaagaaagaaagaaaaagaaaaaaaagcagacaaaatttatttattgacaattcaaaaatttgaaaaagatgaagcagaagcttgacctaaccgacgtgtatcaggacttagctttctatcgcattttcagcacatgtggaaaaattgaattttgatttggtctcaagtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtartccacccatcagtgtatgttttagagtatgttgcattcaatatgtagttttttggttttgttttttgtgacagtctcactctgttgcccaggctggagtgcagtagcaagatctcgtctcactgcaacctctgtatcctgggttcaagtgcttctcctgcctcagcctccctagtaggtggaattacaggcacgtaccaccatgcccggctaatttttatatttttagtagagatgaggttttgccatgttggtcaggctggtctcgaacttctgagctcaagcaatctgcccgcctcagcctcccaaagtgctgggattacaggcatgagccaccacacctggccccaatgtgtagtgtttttttgtttttgttcttgttttttgagacggaatttcactcttgttgcccaggctggagtgcaatggagcgatctctgctcaccgcaacctccacctcctgggttcaagccattctcctgcctcaacctccyragtagctgggattacaggcatgcaccaccatgcctggctaattttgtatttttttagtacagacagggtttctccatgttgctcagactggtctcgaactcctgacckmaggtgatccacctgcctcggcctcccaaagtgccgggattacaggcatgacccaccactcctggccccaatgtgtagttttttatccccacctccctaccctcctctttctgaatctctgaagtccgttatgccactctgtatgcctttgcgtacccatagcttagctcccacttataagtgagaacatatggtttttggttttacattcctgagttactttacttagaatgatggcctccatccaagtttctgcaaaagacattattttattcttttttatggctgagtcatattccatggtgtttatataccacatattctgtatccactcatttgtcaatgggcacttaggtgggttcatatcttttttttttttttgagacagtctcactctgtcacccaagctggagtgcagtggcgcgatctcggctcaccgcaagctccgcctcccaggttcacgccattctcctggcccagcctcctgagtagctgggactacaggcacccaccactgcgcccagctaatttttttttttttttttttttttgkatttttagtagagaccggtgttagccaggatagtctcgatctcctgacctcatgatccacccgcctcagcctcccaaagtgctgggattacaggcatgagccaccatgctcggctggttccatatctttcaattgtgaattgtgctgctataaacatacatgtgcatgtgtcttttttttttttttttgaggcagagtctcgctctgttgcccaggctggaatgcagtggtgcaatctcactgcaacctccaactcgtgggttcaagtgattctcctgcctcagcctcccaagtagctgggactacagatgtgcaccaccgcatccagctaatttttgtatttttagtagagatggggtttcaccatgttggccaggctggtcttgaacgcctgacctcgagtgatctcccctcctcagcctcccaaagtgttgrgattacaggcgtgagccactgcacccagcccacaagtgtctttttcatataatggctgcctttcctytgggtagatacccagtagtgggattgctggatcgaacggtagatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagaaatgtctattcatatcattgggatgcttttcggtgggattattcgttttcttcttgctgatttctttgagttccttataggttctgtataatcgtcttttgtggatgcctagtttgcaaatatttgctcrcattcagtgggttgtgtgtttactctgataattacttcctttgctgtacagaagctttttaatttactcaggkcccatatatttgtttatttttgagacggagtctcactccatcacccaggcttcagtgcagcagcacgatctcggctcactgcaatctccgcctcccagactcaagcaattctcctgcctcagcctcctgagtagctgggattacaggcatccaacaccatacctggccaatttttgtatttttaatagagatggggtttcgtcatgttggtctggaactcctgacctgaagatccgcccagctgggcctcccagagtgccaggattacaggcgtgagccatcgttcccatatatccatatgtttatttttgtttttgttgcatttgcttttgggctcttggtcatgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctatragtatttggctttatttctgggctctctattctgttccattgttctacatgcctaattttataccagtaccgtgctgttttggtaactataggcttgtagtataatttgattgggtaatgtgatgcctccagatttgttctttttgcttagtctttgctttggctatgagggctcttttttggttcatatggattttgggattgtggctgggcatggtagctcaygtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaaggattttaggattttttgttctgtgaaaaatgatagtatyttgatgggaattacaytgracttgtagattgcttttggcagtatggtcattttcacaatattgattctacccatccatgagcaygggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctaytgtttgtgtacattgattttgtatcctgaaactctactgaattcattcatcagacctaggagctttttggatgagtctttagggttttctaggtgtacaatcatatcatcagtgaacactaacagtttgacttcctctttactggtttggatrcccttcatttctttctcttgtctgatggctgtggctaggacttccagtactatgttgaatacaagtgataagagtgggcattcttgtcttattscagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctrtgatttttgtttttaattctgtttctgtgatatatcacatttgttgacttgcatatgttaagccatccctgcattcctagtatgaaacccacttgatcacatcatggcaaatttcaagctaccarcatgaggtcasygagcacagagttggaagacgggtacaaaattagctctccagaacccgtatcaacagactccaacccatggctgccatttctattaaagagacgtcgctgcaggtaatctrtattttctataactagtgactttacagttaaacattccccctgcctctgctcttttgcagcccgattactgaggctgcaagaaagttcacaaggggaacatcctcccccagaaggtaagcatcctactttgccatgaatccctaatgatagtgtggactgcacactggcttgaagccagccattgtcctaaaaactttacgtgtctgattcatgtggtgctcctttgggaatggagaggagcatggactctcccaggtgcctgaggccacgcagccaggaggggcaggatcrgagttcaaactgacactctgtgaaaaatgatagtattttgataggaattacactggacttgtagattgcttttggcagtatggtcattttcacaatattgattctacccatccatgagcatgggatgtgtttccatttgtttgtgtyatctatgatttctttcagcagtgttttgtagttttccttgtagcagtctttcayctccttggttaggtatattcctgagtaytttattttatttttttgcagctgttgtaaaaggggttgagttcttgatttgaatctcagcttggtcattgttggtgtatagcagtgctactgatttgtgtacattgattttgtatcctgaaactctactgaattcattcattagacctaggagctttttggatgagtctaaccataggatccatgtacatagtcgtcagatataccctaggtatgcctaggatccaagtgtcagaggcagaaaaygggaacagcctgaggcaattagcaaattgagaggaaaaatacttcccaaaactacataggttgggagtcatgaaggaatcagacttgacccatggtgggagtacggagaacaagaacaaagtatcagatgaattctgtatggagaagttagattatattatggaggagactatatttgttcaggagaggctatgctgcgcaaagaaaccacaaattgctatagcttaagacacaaagggtttatattttgcttacccaaaaagcgatatgggttgagtgttcctccagggcaacttggctccatgtggggacttaggcatccaagctgtttgcgtcttttttttcctttccttttcttttttcttttttttttttggagacagagtctagccgtgtcacccaggctagagtgcagtggcataatctcagctcactgcaacctctgccttccaggttcaagctattctcctgccccagactcctgaatagctgggattacaggcaactgccaccacacctggctaatttttgtatttttagtagagacgagttttcactacattacccaggctactctcgaactcctgacctcaagtgatctgcctgcctgggcctcccaaagtgctgggattacaggtgtgagccaccgcgctgggccaagctgcttgcatctcgttgcttctcctcttggcacaaggtctccttgtctgttccatgagaggagagagctggagtgccacagaaggccttttgtagccaggcctggaagtattgggcaccagctccacacacctcctgttggccaggatcagtcacatggccccaacctaactacagcagaggctgacaaagatggtcttccttccagttgtggaagatgcaagtgtggctttttcacaggtcaacagtcaggtacagagtgaaggtaggtcctgagcacagcccttcatccacttcatgcctccctccctgttttagttgtgaaggctgccagaacaaagtgccatacataggctggctggcttagcaacaacagagattaatttctcagttctggaggctggaagcccaagatcagagtaccagtagggttggattctggggaaccctcttctgggttgcagagagccaacttcttgccacatggcgggctttaatgttgttttttgacaycagcattcaccatatgctggttatagacaagtctggaaggagaatctatctccaacctgcaaatggctaactaatgttgtgggatggtaggctggtgattgtaccactgcactccagcctggtgacagagcgacaacctgtctcaacaacaacaacaacaaaaaagaaatggcaaccccaaggtgatggtattaagagatggggcctttgggaggtgttgagaccatgagggtggagccctctwgatttggattaatcccttataaaagaagcctcagagagctcactccaaggaatgcggtgaaggttgaagkgtagaatttatgcaaaatgccaagatgagcctggcaggtgacgttctcagcaaacgtgagcagagctattatcagtgtgtgtgtgtgagagagagagagttgaacatcatctaattcatgagtgtggataaaaataagaggggatgccaggcatgayagctcaatgcctgtaatcccagcactttgggaggctgaggggggtggatcacttkaggtcaggagttcgagamcagcctggccaacatggtaaaaccccatcagtactaaaaatacaaaaattagccgggcctggtggtggtgcgtgcctgtagtcccagatactccagaggctgagccaggggaatttcttgaaactgggaggcagaggttgcagtgagctgagattgccccattgcactccagcctgggcaacagagcaatactctgtctcaaataaataaataaataaataaataaataaataaataaataaataaatgggagmctttgcctccaaccctgaagaaaataagcrtgcaaaagatgagtagaggtggaggcagagatgaaggagctagaaaaaagaggccagaaagtcagagagagtgaggtaacatgggggtcagcagaaggcaaggggagagagggtcacctggagaaggaggtcacctcaggaggaaccgcagggcattgcagaagatgaggcagagcagggtctgtgatgttcttggtagggtacttggacagtgtctgagaccacctggatttcttgacgtagatgaaggcggtgagcctgaacacacctggctgactgagatgctcgagaaytggaccaggacctccctggaaaagcaggagcagccccatgaggaccccgaaaggaaaggtaccatgtgtagtgtgataagtgtcatcaacagtaagtgccaccaaccttctcccccctcttgctcttycccacccctgtgggccagtcctgcaggggacatgaccagatgtcccactggtacagtttggatrtttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatrtaaatcattctgttagaaagatacaggcacatgtatgttcactgcagcactattcacaatatcaaagacatggaatcaacccaaatgcccatcagtgatagactggataaagaaaatgtggyacatatacaccatggaatactatgcagccagaaaaaggaacaagatcatgtcctctgcagggatatgggtggagctggaagtcattatcctcagcaaactattgcaggaacagaaaaccaaacaccacatgttctcacttataagtgggagctgaatgatgagaacacatggacrcagggaggggaacaacacacactggggcctgttgggggcgggtggggagaagaagagcaccaggaaaaytagctaatgcatgtggggcttaatacctatgtgatgggttgataggtgcagcaaaccgccatggcacatgtttacctgtgtaacaaatctacacgtcctgcacatgtgtcccggaacttaaaattaaattaaattaaattaaattaaaagaaaaagaaatgtaatccccagtgttggaggtggggcctggtgggaggtgattggatcatgggggcggatccctcatgaatggcttagcgtcatccycttggtgattagtaagtgcttgctctgagttcatgtgagatacggttgtttagaagygtgtggcaccttccccctcrctctcttgctcctgctctcrgcaagtgatgtgcctgctccccaytcactttccatcatgattggaagcttcctgaggccccacyagaagcagatgccagcaccacgcttcctgtacagcatccagaactgtgagacaattaaacctcttttctttataaattatccaacctcaggtacttctttatagtaatgcaagaatggactgatacgcccaccctctatccacccaaccggccatccatccatctaggatgtcttgagtcattagcatgaaataataactctcctactagcaggctgggggtaggggtgacaaaggggaaatgtcagaccaagtgcctgcctggaggactcatggtctagaggacgagatggagaatagacaggtaagccaaccacaggcaagtccatccccgactgggctaatttctatggagagggctgggtgcagtggctcacacctgtaatcccagcactttgggaggctgaggcaggaagatcacttgagcccaggagttcaaaaccagcttgggcaacatagcaagaccccatctctacaaaattttttgtaaaaaattagctggacatggtagtgcgttcccatggtcccagctactcaggaggctgaggcasgaggatcacttgagcccaagaggtcgaggctgtagtgaactatgattgtgccactgcattccagcstgggtgacagagcaagaccctgtctcgaaaaaataataaataagtaaattatatggagagacaaggagaggcgagagcaggtatccggtgaaaaattctgagagtgaagtagcgtggatgagggacaatgaagacagttggtcgctgaagccactgccttcctgagatgacccaggtacagccagtctcacccccagacatccaacctctcacctctgtgatgacccggtgtccaggcrcagacacacccagagtcctcctgaccagctcatcagcagctcaccaaggaaaggaaatcaaggtgtactctcttcagactctagatttcccttcctcctccttttattcatgttacataaattcctgtttttatctctgttggatgaaatcagtctattctctggtttcctttgtctacaatttaaagagggagccgactattaacttgatgtctctgagctattgttggccaagctccccttagatgggattaatgaagaagcctccttttccaaggtgatagctcagaagcaacttgaagaatgagtgacaatgagcctaccaagtggaaatgtggggaaagtcagccagagttcatctactgacttcagtctggcagatgagaggcttgggtttacccctccggtgggtaatggagagagatggaatgtgccacacgaagcctcactatgactttctataatgcctggctcctgtgctgaaatgagaacatgcatcctagccggscatggtggtgcgtgcacctgtagtcccagctattcggggaggctgaggtgggaggattccttaagcccaggagttggaggctgcagtgagctatgaatgcaccactgcactcagagtgagacccccatcccttaaaaagttttcttttaaaraacgtacttttttttgttttgttttttgtttttgtttgtttgtttgagatggagtctcgctctgtcacccaagctggagtgcggtggtgcaatcttggctcactgcaacctctgcctcccgggttcaagcgattctcctgcctcagcctcccgagtagctgggaccacaggcatgcaccaccacacccggctaatttttgtaattttagtagagacagggtttcatcatattggccaggctggtcttgaactcctgaccttgtgatccgcccacctcaggctcccaaagtgctgggattacagatgtgagccactgtgcccggccaattcttaacttactataagatatacttgagcccaggtattcaagactagcctggaaaacactgtgagacctcatcttttttaaacaaaattaataaatagataaaacrtttaaaaaagccaggtgtgatggctcacgcctgtagtcccagctactcaggaggctgaggcgggagggtcgcttgaggccaggagttcaagaccagcaagcctgggcaacgtagtgagacctcctctctaaaataaataaataaaaatataagatagaatggccgggtgtggtggctcatggctktaatcccagcactttgagaggccraggtgggcggatcgcttgaggtcaggagcttgagaccagcctggccaacatggcaaactctgtctctactaaaaatgcaaaaatacaaaattcgccgggcgtggtggcacatgcctgtaatcctagctacttgggaggctgaggcaggagaatcgcttgaacccgggaggcggaggttgcagtgagctgagatcacgccattgcactccagcctgggcaacaagagtgaaactctgtctcaaaaaaaaaraagaagtatgkagtcctcaggccacatttagttttctttaacatgttaaatattaaagggctatcaaagcaatgtaggtgtgatttgcttttctgctgctaaactcttgtagaagttaatatttattaagtgcctactatttgctggatgtgttaggtttcttcagagaaacagagccaataagatatctatctatctatatctacctatctatgtctctgtctgcccaaatctatgcatctatatctatgtatttatagctatctatctctatctatctaactagagatatttattttaacaaattggctcatgggattgtgaagatgacaagtccaaaatccatggggcaggccaacaggccggaaaccgagacmggattttttaaaatttaatttaatttaaagtttgaggatacatgtgcaggacatgcaggtttgttacccaggtaaacgtrtgccatggtggtttgctgcacttatcaacccatcacctagatattaagccccacatgcattagctgtttaccctgatgttttccctcccaccgccccctcaacaggccccagtgtgtgttgttcccctccctgtgtccatatattctcatcattcagctgccacttataagtgagaacatgtggtgtttggttttctgttcctgcattagtttgctgaggataatggcttccagctccatccctgtccctgcaaaggacatgatcttgttcctttttctggctgcatagtattccatggtgtatatgtgccacattttcyttatccagtctaccattgatgggtatatttggttgattccatgtctttgctattgtgaatagtgctgcaatgagcatacgcatgcatgaggcagaatttgacgctccagtctggaggtagaatttcttctkctctagaaactgttttgccctcaaagccttcaactgagtagatgagacccasccacattactgagaataatcttcttgaagtcaactgattttagctgtcaaccacatctacaaaataccttcacagccacatctaggctagtgtttgattaaataactggttactgtggcccagcctagttgacatgttaaaccatcctcccaacatcctaagtgctataggcaggctcttacttattcytcataaatctataagggataggtgttactctcttcctggttttacagatgagaacagagatgttaagtaacttgctcaggggcccggtgcagtggctcatgtttgtaatcctagcactttgggaggccgargtgggwgratcacctgaggtcaggagttcgagaccagcctgaccaacatagcgaaaccccgtctctactacaaatacaaaaaaatatttagccgggcgtagtggtgggtgyctgtggtcctagctatttgggaggctgaggcaggagaatcacttgagcscaggaggcggaggttgcagtgagccgagattgcaccactgcactacagcctgggtgacagagcaagactgtctcaagaaaaaataaataaataaaagtaacttgctcagggtcacacagctaatgagtgatgaagtcaaattcaaatcagcatctagctcaagcacccacctccctactagctttgctctcttgccactctgcccctgctgttcagagaaaggattggagctgaaaaaccaggaagagggaaatcagagggggaggcagtgttgcatcctggatggaaaagatgctgcataaggtactggcagatgagattgggaggagcagagacactgaagaggaggtggaattggcaggtcttggtgatagtccagggtgagggtgargaagaggcaggcgtctgggataatgacctggtttatccctgactgacttggcagcctcttgggctggggaagggagcacgggaaagtgtgctgggcattttggaacagctcctggaacattctgcgtcgttctcccccatgaacctaaagagaacaagctcatttccccagatacacaggtgatcatacagtcattaaatcgccatcttttccttgccaactcccccaaccccaatggctcaaagtcatctcacctgtggctcaatgatagatgctggatctgacggccaggacccccaggcccctgtatgccaacctttcccagctcaccagatttgtcagctctgctgccctaacaaaagttgaagtggggtggcttcaactataggcttttatttcctcaccgtttttttttttttttttgagatggggtttcaccatgttgcccaggctggtctcgaacccctgacctcaagtgacccacccacctgggcctcccagagtgctggaattacagatgtgagtcactgtgcccagccttattttcttacaattctgcaggcaggaagtccaagatcaaggtgccagtggggtcagtttctcctgaggcctctctccatggcttgcagagggatggccrccttctcaccgcatcctctcagcccagcctttcctcagtgcacacgcattcttggtattcttggtgtcttcctttttttcttttttttttttttttagatacaaggtctcccttgtatctaaatgatctgagtgatacaagtgaggctggaatgcccaggctggagtgcagtggcacaatcatacatagttcacttcagccttgaactactgggttcaagtgatcctcctgcctcagccttctgaatagctgggaccacaggcatgcattaatatgcccagctaatttgtttattttattttatttttgtaaagatgyggtctcgctctcttgcccaagctggtctcaaacttctgggctcaagcaatcctcccacctcggcttccctaagtcctgggattactctggtgcctggcactctttctcttctcataaagaccccagtcctattgaattaggatcccactctcatgacctcagttatcctgaatgacccccccacttttttttttttttttttttgagatggagtctcgctccgtcatcaggctggagttcagtggcacgatctcggctcacttcagcctctgcctcccaggttcaagcgattctcctgcctcagcctccccagtagctgggaytacaggcatgcgccaccaccacgcccagctaatttttgtatttttagtagagacagggtttcaccatgttggccaggatggtctcgatctcttgatatggtgatccttctgcctcggcctcccaaagtgctgggatgactggcgtgagccaacgcgccggccctgaatgacctctttaaaagtcctgtctccagatacaaccccatgggggatgagggcttccacatatgactttggtgggggcagaaaccactcagtctyctgaactcaccttggctgtctcggcttctttccctaggctcactcagtaacttgatggattttgtgaagaaaacaggcatttgcgcttcaaagtgggaatgggggaccmctcacaacttcctgtacaaacacggtgagaagaccctcttcccacygccctggtctgtccttgcgtgtgaatgggctggagtaggggaagggggtgggcctgaaacaatcccaggcyggtccttccccagagctttggaggggggtggtgtcaaagkgcccagggatctgattaggggaactttcrctcagtggtgtggtccatactgaaaaatgtgtggcctcgctgcgagtcccagtcatcgtgaaaagcctcactgatggctttctctggttttgcaaaaatgcaraaaaccctaatttcttgtcagctagtcctaggacctggtcttcaaaaacacttgtatgggctgggcgcagtggctcatgcctgtaatcccagcactttgggaggctgaggcgggcggatcacttgaggtcaggagttcaagactagcttggccaacatggtaaaaccctgtccctactaaaaatacaaaaattagccggacagggtggcgggtgcctgtagtcccagctactcaggaggctgaggcaggagaatcgtttgaacccaggaggcagaggttgcagtgagccgcgatcatcccactgcactccagcctggcaacagagcgagacaccatctaaaaaaaaaaaaaacaacacacatttgtatgggttttcccttcaggggactgaccctctcattcaggtggaattgatgtcagactcctgggaactcacactgaggccatttaatagtctccataagctccaatgttcatagctggtggagatcctctcctatgaccatgccaatccctgcaccactcatgtatgtgtatgtgtgtgtgtgtgtgtgtgtgtgtgtgtgtcttgctctgttgcccaggtgggaatgcagtggtgcaatcatrgctcactgcagcmtcagcctccmsagctcaagmwatcctcccatttcagcctccmgaatagctgggaacacargcacacagcaccatgcctggctaatttttctttttctttttcatagagatggggtctcactatgttgcccagactgatcttgaacccctgggctcaagcgatcctcccacctcagcctcccaaagtgctgggattacaggtgtgagccaccccacaccwggccttccccactcttttgttacaagactatcgtgaacatctttatgtttgtggtcctgttgcccttgtgcaaatcgagaaaaggtgcatcttccaggggggtgaattccaaaatgtgcccccctggccagggctgtgtgtggcctgggaagggaaccctggctggatgtcagtcctgctcacctctcctggggtgcttcctacaaggcacacaggacttcagctgtgtctgmgcaccatgccatgcagctgccgggtcttatggcctcggaatacaccatcaagcatcaagtcastggatcatggcgatgagtgttttagcatcaaatttctccctgaaggggttggatgaagtcgctttctcagtagcaatatatgagagtgtaaaccaaaaataaaattctaagccccccaccacccaaccatctgaatagacctctcctgtcagccagggcactccaaagttaacctgaaaaatgggttcagtccctgatgggaagtgggggtcggacatgcctccttataccctcctcccttttggaattcaggaaaagctgactagcagtcatgtcaacacaaatttttttttttttttttgagatggagttttgctctttttgcccaggctggagtgcaatggygcgatctcagctcaccgcaacctcsgcctcctgggtttaagygattctcctgcctcccgagtagctgggattacaggcrtgcgccaccackccyggctaattttgtatttttagtagagacagggtttctccatgttggtcaggctggtctcaaactcctgacctcgtgatctacccaccttggcctcccaaagtgttgggattacaggcgtgagccacctcaacacagattttaagtctgataagaaacatttacattctgttctctctgaagcctgctacctggaggcatcatatacgtgataaaactttggtctccacaaccccttgtcataacccagacattcctttctattgctaataactctttaaaccaatagccaatcagatatttttattttattttccatatatttatttattaattatttttatttatttatttatttattttgcgatggagtctcgctctgtcacccaggctgcagtacagtggtacaatcttggctcactgcaaccaccacctcagcctcctgagtagctgggattacaggcacatgtcaccatgctcaactgatttttgtatttttagtagagacagggtttcaccacattggctaggctggtctcaaactcctaacctcaaatgatctgcccaccttggcctcccaaagtgctgggattataggtgcacaggtgtgagccactgtgcccaaccgtcaatcagaaaactttaaatctacctataacctggaagcccccccccgacccctcctcacccctcacctctacccctccatgacttcaagtcgtctcacctttctggaccgaaccaaggtatatcttagatatatttgattgatgtctcatatctccctaaaatgtataaacctaggctgtgccccaaccacctaggccacatgttctcaggatctcctgaggactgtgtcacgggccattggtcactcacatttggctcagaataaacctcttcaaatattttccagagtttgactcttttcatcagcaagaggaaccattcccagaggtactgtcttagtctgctcaggctgctgtgacaaaatcccacagactgggtgacttaaacgacagacatttattttctcacagttctcaaggctggaagtccaaaatcaagttgtctgtggggtgagttctttctgaggactctctctgygatttgcagacagccaccttctcatatcctcgtatggtctttgctccatgtgtgtctctgttctaatcccctcttcttagaagagcactagtcattctattggaatgtttcaaagttttatcatgcagatgtgtgagaggcattggaaccagagtgactctatcttgaatgagggctaggaaaaatgaggctcagccttgctgggctgtatccccaggaagttaggcattcctagcctctagatggttatggttaagggaacagattcataatgtttactaaacagactcagacccaggaatgtcctgatatcctgatatcttgagaacagacgcattcctaattttgctttaaaaataataatataagttcttgtaaaatatagtaattatggtttttggtttttttttttttttgagacagagttttgctctttgttgcccaggctagagtgcagtggcacaatctcagattactgcaacctccgcctcccgggttcaagcgattctcctgcctcagcctcccgagtagctgagattacaggcaggtgccaccacgcctggctaatttttgtgtttttagtagagacaggatttcaccatgttggtcaggctggtcttgaactcctgacctcaggtgatccacccaccttggcctcccaaagtgctgggattacaggcrtgagccaccgtgcccggccaaaatagagtaattatgaaaattaatcctttatcacaaatacttgtagcagagcacatctccccatgtttttttgttgttgttgttttcctatatataacaaaaggaggaggtggttgcatttctcctcttactttccgtaacaccctactctgtggagtaacgattctttcacccytttgctttcttaacagacttgctttcgctttgcactgtggactcaccctgaattctttcttgtatgagatccaagaaccctttcttggggtctggatcrggacccctttccagtaactgatgaaggctccaggtagcaagcttcagagagaatagattgtaaatgattcttgtcagacttaagctctgggtggatattaaatgctggtcagctttccttaaatccccaaagggaggagggcatcgtgaggcatgtctgaccctcccttcctgtcacggccagaactaggttttcaggttaactctggggtgccctggccaagaggaagggttcattcagatggttggggtggtgttgtgggggggtaggagttggggagggtgttggcggggggacgggagggatgggggtgggggggaggggcttatcattttatttttggtttacgctgtgaaaggaaaataaatctcgggaccccaaaatcaccaagttaaagggaaaagtcaagctgggaactgcccagggcaaacctgcctcccattctattcaaagtcaccctctgctcactgagataaatgcgtatctgattgcctccagttggaaaggctaatggaaactctaaagaatgttggccggcccgtggctcacgcctgtaatsccagcactttgggaggcagaagcgggtagatcacgaggtcaggagttcaagaccagcctkgccaagatggggaaaccytgtctctactagaaatacaaaaattagctcagcatggtggcgggtgcctgtaatcccagctacttgggaggctgaggcagagaatcacttgaagccaggaggtggaggttgcagtgagtggagattgcgccactgcactcccgcctgggcaacagaacgagactccttctcaaaaaaaaagaatgcaaccattcacttcttatctacctgtgacctggaagccccctccctgctttgagttgtcccacctttccagaccgaaccagtgttcatcttacatatattgacatctcrggtcttcctaaaatgtctaaaccaagctgtgccccaaccgccttgggcacatgtcatcatgacctcctgaggctgtgtcacggttgtgcatccttaaccttggcaaaataaactttctacactgaccgagacctgtctcagaaacattgggttaacaacrctctcacatattgctgctgagaaggcagcttcatttggaacttcacgccaaaaaccccattttaccttaattacctctttaaagaccctgtctccaaatacagtcacattctgaggtactggaggtaagagcttcaacatgtgtttgtctgtttatttgtttatttatttgagatagagtctcgctctgtcacccaggctggagtgcagtggcgcgatctcagctcactgcaacctccggctcatgggttcaagtgatcctcctgcctcagcctcccaagtagctgtgattacaggcacccgccaccacgcctggctaattttgrtatttttagtagagacagggtttcactgtgttggccaggctgatcttgaactcctgacctcaagtgatccrcctgcctcagcccccaaagtgctgggatttcaggygtgaggcaccgcacccagycagggcttcaacatatgaatctgggaagagagagaagtcagctcctagttggcaacctcacaactgctgtctacactgacaacgatcattttcccatccccctytctgccttccatttmcaagtcttgctttcagtccccagaagcagctgatcctctttcttcctgggcaccacaggtggcatccgggacaagataatgagcagccggaagcacctccacctggtggatgctggtttagccatcaacactcccttcccactcgtgctgcccccgacgcgggaggttcacctcatcctctccttcracttcagtgccggagatcctttcgaggtaatcgagaagggctttggggccggtcctgggtgggaggtgggctgyggcgaagctgactttgcggaggaactgaggacgcgggctgggaagcgggcaatggggaggtgctggctgggaagtccagagagccaaatcaactcacccatcgctcccgaagcacccgcrgtcggccacatccaacgaacttctgatccaaagccatcccagaccttcccgggccsctcttcctggcagatgactctccccgcttctgcgtcctgcctgcccattcataccagtttgaactgcaacagcctagctcctcacctgtgcacctccttccccrggtgtgcacgtctccagccccgagcgcgtgtcttcctgctcatctgggtttcctgggcaaatagtggccctcaataaatgtttgctgagtgagaacatatgcaagtatatttgtcttagtacatattgcaccttcccagtggccactrggatccgttctccctgccttcatatcccagctctgccacttaccagctgtgtggcctgatccaatgtgcgtaacttctgtgcatgtcggtttcctcagctgtaaaattgggctaacgatggctccaccaggagttgttctgtggattaaattaatacttgttaatacatgtgaagtgcttagcacagtatctgccacttactgtggggtttataaacattttcctcccctcccytcccctcccctcatggcctcctttcgagactgggtcttatggtgtgatcatagctcactgcagcctcaacctcctgggctcaagcgatcctcccacctcaccctcccaagtagctgggactgcaggcacacaccaccacaccaggctagttttctaaattgttttagagacagggtcttgctatgttgcccaggctggtcttgaactcctggcctcaagcgattctcccaccacccaaggctaggattacaggcacaagccgccctgcccagctattttattaaaaaatatatacacctacataatatataactatatctattacatgrtacataccaatacatagtagtatatataaaataatcatggtaaaacatatcatctattatatttatgtgtaatgtaatatatatttatattcacacacttctatcagtttacattctgtaatatgaattaggaacatccatcctcctccccataccatratccagaaccaacttgtcaccatctttctagacccttggcccaggaatacccaggctttctggtcttaggatttctgctgaaataaatatcccaagacaatatgataaaggtggaatgagatatcaaggtcttgggagtccttttctgccaaatctctgctgcatgaccccgagcgataggcttaacctctgaacctcagttttctcatcctgaaaatgggaatcacatcatctggctcgcaggagatctgcagagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagsacttgaaatgtgcctggcccaagttgaagtgtgctatgaagataaaatacacctcggattttaatgaccgagtatggaaaaygcatgtcaaagaccttattcgtaattggtatattgacatactwggcagggctctccagagggacagaaccaataggatctatgtctagatgaaagggagtttcaggatcacaaggtggagtcctacaataggccgtctgcgagctgaggaagaaacaaaccaatagtggctcagtccgagtccgaaagcctcaaaagtagggaagcccagccaggcctggtggctcacgcctgtaatctcagcattttgggaggccgaggcgggtggatcagaagatcaggagttcgagaccagcctggtcaacctggtgaaatcccgtctctactaaaaatacaaaaaaattagcygggcgtggtggcaggtgcctgtaatcccagctactcgggaggctgaggcaggagaatcacttgaacccaggaggcggaggttgcagtgaaccaagattgygccattgcactccagcctggtgaacaagagcaaaattccatctcaaaaaaaaaaaaaaaaaaaaagtagggaagcccacagtgcagccttcagtctgtagccaaaggccgtagagcccctggcgagccactggtgtaagtctaagggtccaaaggccaaaaaacctggagtgtgatgttcaagggcaggaagtatccagcacaggagaaagatgaaagccagaggacccagcaagccagcttctcccaccttcttctgtctgctttgttctagtcacactggcagccaattggagggtgtccgcccacactgtgggtgagtcttcctctcctagtccactgactcaaatgttcatctcctctgacagcaccctcagagacacatccggaaacaataccagctttccaggcacccttcaatcaagtcgacacctaatattcaccatcacaattgattacacatcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctcagcctcccgagtagctgagattacaggcatgcgccaccacacccagctaatttttgtatttttagtagagacggggtttcaccatgttggccaggctggtctygaactcctgaccttgtgatcygcccgcctcggcctcccaaagtgcagggattacaggcgtgagccaccacgcccggccaataaacagaaatttaagcaagacatatctgtaacaatttaacagaacctgattgtctaagttttttttcatttttctcaaattcatctttaattctttccatgatggggcttataaggaaactaaccaacatgtagctactatagttgaatgtcaaatcttttttttttttttgagatggagtcttctgtgtcgcccaggctggtgtgctgtggtgcgatcttggctcactgcaacctycgcctcccgggttcaagtgattctcttgcctcagcctcctgagtagctgggattacaggcgcccgccaccatgcccggctaatttctgtatttttagtagagacggggttttgccattttggccaggctggtcttgaactcctgacctcaggtgatccgcccacctcagccttccaaagtgctgggattataggcatgagccactgtgcccagctgaatgtcaaatctttagaaggtacttatgacagtaaattcctctgtaatacaggtatgaagcaccttcatgatatttctgttttatgtgtagaaaagtggctgggtrcggtggctcactcctgtaatctcagtgctttgggaggccaaggtgggaggatcacttgagatcagcaatttgagaccagcctgggcaacatagcaagaccccatctccacacaaattttttttttttttgagacggagtttcgctcttgttgcccgggctggartgcaatggcacgatatcggcttgccacaacctccaccttccaggttcaagcgattctcctgcctcagcctcacaagtagctaggattacaggcatgcgccaccacacccagctaatttttgtatttttagtagagatgggattgctccatgttggtcaggctggtcttgaactcccgacctcaggtgatctgcccacctcagcctcccaaagtgctgggattacaggcgtgagccaccacacccggccaaaaaaattttttttgattagctgggcatggtggctcacgcctgtagtcccagctacttaggaggttgagatgggataacctgagtctaggagcttgaggctgcagtgagccatgattgcaccactgcactccagcctgggcgacacagcaagatcctgtctctaaagataagtatatgtagaaaactgttagactcaaatattcaactcaatataaaataagaagaagccgggtgcggtggctcacacctgtaatcccagcactttgggaggtagaggcrggtggatcacctgaggtcaggtgtttgagaccagcctggccaacatggcgaaaccctgtytytactaaaaatacaaaaattagccaggcatggtggcacgtgcctgtaatcccagctgctagtggggctgaggcaggagaatcgcttgaayctsggaggcggaggttgcaatgagccaagatcccgccactgcactccarcctgggcaacagagcgagactctgtcaaaaaaaaaaaaaaaaaaaaaaaaaaraagaagaagaagaagaagaagaagaaacacttgttgagactgcatctccttttgctaatgagtggtttctagttgtaatatcactcctctgaataaagaagccacctttgagtacataaggaaaaataaccacatgttaaaaggataagacattactccgacatctctactgggccatctcttcctctaacacttcagaaacttagaaatttaaaatattcttacgttaactgcaagaacaagataaaggagaaatgccctttttcttgagatcacaactatgaagtcatatgcttatgcaacttctgcatttgtgtgcaaaacacaaacacactgatctttttttaacttttaagttcaggggttcaagtacaggtttgttccataggtaaacttgtgtcctggggatttgttgtaccgattatttcatcgccccagtattaagcctagtacccattagttatttctgctgaccctctccttcctcccgctctccacccaacactaggccccagtgtgtgttgttctcctctgtgtgtccatgtgttctcatcattcagctcccacttagaagtgagaacatgcagtatttggttttctgttcctggaaacacatttatacatttatcttttttttttttttttttttttgagacagagtctcgttcttgttgcccaggctggagtgcagtggtgctatctgggctcactgcaatctctgcctcccatgttcaagcgattctcctgtctcagcctcccaagtagctaggactacaggcatgtgccaccatgcccggctaattttttgtaattttagtagagatggggtttcactgtgttagccaggatggtctcgatctcctgacctcgtgatccacccacctcagcctcycaaagtgctgggattataggcatgagccatgagccaccatgcccagcctctttcttgctcttgtcacccaggttggagtgcaatggcgctatctgggctcactgcaacctctgcctcccgggttcaagcgattctcctgtctcagcctcccaagtagctgggattacaggcacctgctaacatgcctggctaatttttgtatttttagtagagacggggtttcaccatgttggccaggttggtctcaaactcctgacctcaggtgatctgcccgccttggcctcccaaagtgctgggattacagacatgagccaccacgcctggcccgcattgatcttaattctccttgcttagttttgtcagtcagcttgcaggacttaacagatgcctttctaagacacagagactgagatgtgttttatgtaagtttagtaacctcagtgctacagtaatgagacatgcagtgtccttttgctctggttcaggacagcacggaaggaggccacaggaaagagaataaatgaaacttgttacaactgagaaactacttctcattaagtttccccatggtgtcacctttatttaatatttatttttaaaattaatttctcctacttctttttactttcttcragtgcagcaagtagacaattgaaaagtacctttacggccgggcgcggtggctcatgcctgtaatcccagcactttgggagactgagacnagcggatcacctgaggatcaccaacctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctsagtagctagggctacaggtgcacgcccccatgcctggctaattgaaatatatatatatatatatatactgtagagatgaggtctccaacatctttctgtggcagagctggrattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccrttgggtctccaggccccrggggtcttctggaggggtcttctggagaggtcttgcaaccatttcttattgcctccttctcagaccatccrggctaccactgaytactgccgccgccacaagatcccctttccccaagtagaagaggctgagctggatttgtggtccaaggcccccgccagctgctacatcctgaaaggagaaactggaccagtggtgatrcattttcccytgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggatkgagaggcctcaggaaacttacagtcatggtggaaagcgaaggccaagcaagtcaccttcttcacaaggcggcaggaaggagaagtgagtgccagcagggcaattgccmgatgcttataaaatcatcagatcagccgggcgcggtggctcatgcctgtaatcccagcactttgggaggctgagrcgggcggatcacaaggtcaggagattgagaccatcctggctaacacagtgaaaccccatctctactaaaaatacaamaamaaaaaaaaataaattgctgggcttggtggtgcgtgcctgtaatcccagctactcaggaggctgaggcaggagaatcgcttgaacctgggaggcggaggttgcagtgagctgagatcrcgctcctgcactccagcctggggacagagcaagactccttctcaaataaataaataaatacataccatcaggtctcgygagaactcaactcactgtcacgagaacagcatgagggtaaccacttccatgcttcaattacctccyacracacttggggattatgggaactacaattcaagatgagatttgggtggggacacagccaaaccatatcaccaccaggccaggccgaatggagctgtgctgtgccctggggacatcttgttacgctccaacatctgatggttgagtgagtcatcctgtccacccttgggcctggaggatgccaggctgcctctctcggtcttgcatgtttatgcatgttgctgcctctctctgcagccttcttgtcctacctgaatatccaaccccttccacctgggcatcccacattcytcatccagtctcaggtgagcagctgcttggaaggcctagcatccaggatgggtggtcctccggggcctgattgtgccacttcccacagtgggctccttttagcttgtcaatcgtgtctcctgcgatgagactccyattagggataaattgtgtctgttttcttccttcatttaaygaacatttattggttacctatgctgcatcagccrtggttccaggagaggcaggctagagtagtaaagaagacaggaagcrgggggccaggygcggtggctcacgcctgtaatcccagcactttgggatgccaagccggggcagatcacctgagatcaggagtttaaggccagcttggccaacagggtgaaaccccgtctctattaaaaaatacaaaaaattagccargcgtggtgatgcacgcctgtaatcctagctacttgggaggctgaggcaggagaatcgcttgaatctaggaggtggaggttacagtcacccaagattgtgccattggactccagcstgggagacaagagygagcctctgtctcaaaaaaaaaaaaaaaaaaaaaagaaaaaaggaccggaaggggcatggatcataaaaatatagataaatccataacctcatgtgtcaataaaactttatttataaagccaaagtagtgggccgactggatttggtccacaactgtagtttgccaagccctgatgtaaatagayaaaaatctgcagaattaattgtccaaactcatgatgccttttctttgttggtttsgttatgcttcaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagtaagtatctgttggagaactttctctgcaacaggcaggagggytgcatgggtgaaaaaagataggcagtgtctcccctacttgagcttgcgtctcagcaggggacagaccatgaacagggtcaggagtgaatggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggctgggcgacagagcaagaccttgcctytaaaaaaaaaaaaaaaaaaaaaaaaattaagctgaaagcttaattaagctgagtcatgcaagaaactgtctttccttttgttcctaagccacagataaaaggccacagatatctccacaggtaacttactctatcgatatggtttggctctgtgtccccacccaaatctcatctcgaattgtaatccccacatgtcaagagagggacctggtgggaggtgattggatcttgggggtggcttcccttatgctgttctcgtgagagtgagggagttctcacgagatctgatggtttttaagtggcagtttcccctgctctctctctctctcgatctctctctctcatctctcctgccaccctgtgaagaaggtgccctgcttccaccatgactgtattaggttggtgcaaaagtaattgcggttttgcaactaaaagtaatggcaaaaaccacaactacttttgcgccaacctgataagtttcctgaggcctccccagccacatggaactgtgagtcagttaaacttcttttgtttatacgttacccagtctcaggcagtgtctttatcgcagtgtgagaatggactcatacagttctagaagtcagaaatctgaaacgagtgttatggagcaaaacccaaagcgttagcagggccaactcctgcggaggctccaggggagaagctgttccttgcctttttcagcttctaggggccacccgcattccttggctcatggcccctccttcagcctcttgcttctatcatctcatctcctccttgctctgacctcccgccttgctcttataaggaaagatccatgggattccactgggcccacccagatacccaggatcctctcctcatctcaggatccttagattaatctcatctgcagagtcccttttgccatggaaagtcatgtactggccaggagccgtggctcacacctgtaatcccagcactttgggaggctaaggcaggcagatctcttgagctcaggagttcagaccagcctgggcaacatggcaagacaccatctctactaaaagtacaaaaaaatagcaaggcatggtggtgtatgcctgtggtcccagctccttaggaggctgaggtaggaggattgctgaaccctggggagcagaggttgcagtgagcccagatcacaccactgcactccagcttcgatgacagagcgagaccctgtctcaaaaaaaaaaaaaaaaaaaaargtcacatactcacaggctcyagggattaggatagggacatcattaggagacattattcaacctgccacaaagacacagacacaaccagatgacagaagccaggggaagagttggaatattattctgaatatggtgggaagctgctgttaagttttgagcagggaagtagctttatctgagtcaccttttcaaaggcccaccctagctcctgtgcggttggtccctaggtgagataattagcaccctgaggagcagtttgggtcaatgacctcagggtcgcaaggtagagggaagagaaagccattctgggcctctggaccagtctatgttccccagagmgtttccccaaaagccctgcctggcatggggcagggcggttatttgctgctcatctgtcttctaatgaggggttgtatattagtttgctggggctgccattaaaaagtaccacagaggccgggcmyggtggttcacacctgtaatcccagcactttgggaggccgaggtgggcagatcatgasgtcaggagttygagaccaacctggccaacatggtgaagccccatttctactaaaaatacaaaacttagatgggcatggtagtgcacacytgtagtcccagttacttgggaggctgaggcaggagaatcrcttgaacccagaaggtggaggttgcagtgagcccagatcatgccactgcactccagcctgctgacagagggagaytccgtctcaaagaaaaaagtaccacagatcaggtggcttaaacaaccgacacttattgtctcacagttctgraggctggaagtccaagatcaaggtgtgaacaggggtggtttctcctgagrcctctctccttggcttgcagatggtgcctccctgtgtctacacatgattttcctctgtgcctgtccactccycaccttctcacctgtagaactcagggcttatttatgcttatttgttgrctctctctcctcataataaggtgtgcagcagtgtggggtcaggaaccacatcactttgctcaccatggtgttcattcttycattcattgattccacaaayatttcctggatgcctgctagrtccagtccgcccaggtcctgcagccgtggctgcatacaggtcagatgaggctcttgctcttgtagaatgtacctcctyccgggggggcaacatgacataaacaggtaaacaaagaagtcaacaggatggccatggagagtaagtgccatggagacgaccgaacgtgcggtgtgctgaggagtraagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcrgtaatttataaaggaaagaggtttatttggctcatggttctgtaggctgtgcaagaagcatggcgcctgtatctacttctgrtgaaggcttcagagagcatccaatcctggtggaaggggaaggggggctggcgtgttacatggtgagagagagcaagagagagagaagggaggaaagcaccagtttccttttaacaaccagatctcaartgaactaatagagcaagaactcactcattaccgcagggaaggcaccaacccattcatgaaggatccactcccatgatccaaacatctccctctgggccccacctccaacactggggatcacatttcaacatgagatttggagrggacgaatttccaaactatatcagtctattcgaggaacagaaggaaagctgttattgctggatcagggtaggggaagcacggaatgaaatgtgattggagagatggacagagatcagawcttgtgaattctggcaggtatcatgacattcgatgtagrccaaagagttacctcctagcccagctcctgatacatgcttaataagcrtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccartgtgcaacactgcctacaaagcacagtggtaacttctaactttcctttctccccaggctctactacccgaaggatagtgcccgaagttgctgcttggcatagatgagcctcagcttccagggcactgtgggcctgttgrtctactagggccctgawgtccacctggccttcctgttcttcactcccttcagccacacgcttcatggccttgagttcaccttggctgtcctaacarggccaatcaccagtgaccagctagactgtgattttgatagcgtcattcagaagaaggygtccaaggagctgaagrtggtgaaatttgtcctgcaggtcccycgggagatcctggagctggagcatgagtgtctgacaatcagaagcatcatgtycaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcrtctgtagaatagaccatcacrgagcctgtatcctagaaaggcttaaatgagttmatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcaytcgtgtggaccctaatccacaatgactagtgtccttatgaaaaggrgagatttcgccgggcgcagtggctcacgcctgtamtcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaargaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcrgcacatgtatcccagatttgaaataaaattcttttaaaaaagbgggggggwtttaaagacagagacaggcatgtatacagagaggaaaccatgtgaacatggaagcagggattggggtgaggctctactgaccaagggcygccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctccygagtagcagggattacaggcatgtgccaccatgccbggctaatttttttgtatttttagtagagacrgggtttctccacgttggttaggctggtctcgaactcctgacctcaggtgatctgcccacctcagcctcccaaattgytgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataamgtaactcctttgaaattggtattttgtagggaggtattttgagctctgtaaatatcaaacttctcacttagctttttatttatctgagtatggactcctggtttcttctgtggtcctgtataatttgttactatcattatttattttgactctcaaactgcccagtatggccaatggagcttcttcaagcagactcctgtgttctttccacatgttctcacaacactttgagcaatttcttgctttaagcataggacgtttgtaggctcatcttgttctttttttgctctagacatggaatcagccaaatttcctaggcactctggttccatttggtggagaatggtatatagaagtcaagatttggatgctagtggtgctcattcrtatgggccatcattgtttctatgttctcttagtggagagagctagagaatatgtgtacaaatgttcctatacacactgaaactatgtgtttatttttatctctctatgtataattgagatccatgaggacataccaacgcctccagttatagtccaacaccacagggctcattcgactttcctcctttctgtcttagtaactcccttttccaacagtaggagacctggcccccattccccttactcactgtgtgtagccaatttcccttttcctttgccatttcacccctgtggggatgtctttcccagcctagtctggcttcaacaccatacaccatgctattcccatgagtggacatttctctctctgcttgggttatgacaacccatgccagatcccctctatgtggcctccttcctaattgccttacagtgcaaacctccaccccagacaatgcctgcatataaatgcccccgccccactcagctcatgttccaacactgcacaccaagctgcccrtctgtggatttatccccaccatctccagccccaacaccctgggtcatgctgcccctctatgtggacttctcctcaccccactaccccactggaatgctggctctccacgccagatggcccccagccccctcctcccctaaccctacctagtgtrgagtcgcaaaacccctttgggctttgacaccaccataacttcacaccctccctgacacccccaccttgctttttccctctaaatcattcaggaaagacagaaggaaagagatgaacagaggaagagcaaatgccatgctcttagtcaccgtgtacgcccacttcctgaagtccatgcttgcatcctgctcactctcacacattcccgactcacccaggaaaactccctgaggccaggggtgctgagctctccatctcactgcccagaggccagtgttggagtgacccttcacatgcttgttggaacattgaataaatgatgccgtctgctctaatcctccattttcttttcttttttttctttttttttctttttttcgagacagggtctcactatgtcagccaggctggagtacaatggtgcaatcgtagttcactgcagcctggagtgcaatggtacaatcatagctcactgcagccttgaactcctgggctcaagcaatcctcccatctctgcctttggagcagctgggactacaggtgtgygccaccatgcacggctaatttttttattttttgtaaagacagcctctccgtatgttgctcagctggtctcaaactcctgggctcaagcaatcctcccacctcagcctcccaaagcgctgggactacagacatgagcaccacatccagcctctaatccccatttataaaatgcactttccarttccactctggggataaaggcgtcacagaacctgactctgcatttccccacccatatcattcaagccagatggggaggcagggacagctctggtccctccccaacccgggtagagatttccarcccagctgtcacagctctaagacaccgggaccgaaggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcytgaggaaaggcattgctgagaaacascgggtgaggtggggagtgagggggaagggcggtgggcggggcaaagggagcaggggtgtgggacaaagaaggggacatgatggtgccacagaaccaggggaacaggtggatagagcaggagctgagaaggtataagaaattccaaggaccctggtggggtcatgtaagccagtgagataaatgggtgggggtaaaatcaaaagtcaggagcaaagagaaggagagaaaaggaagaaaaatgaaaagggaaagtgggatgatgtcattgttgagattaccatcattcttttctatggatgctcattgtgataatggtggtgatgatggtggtggtggtgatgataatgatgacgttaataacaatagctgccacttattaagtcattgttctgtgcccagccctgtgcaaagggatttgcacacctgatgttatttacacctcagaacaactcatgaggtcagtgactttcattcccattttacaggtgaggaaagtgaagctctgagtcatgaagtcatttgccttaagcttacacagttagtaagtggcagggtcggccaagtatagtggctcatgcctgaatcgcagcatcttgggaggcagaggcgggaggatcacttawgtccaggagtttgagaccagcctgggaaacacaagaccccatctctactaaaaatacaaaaaaatagctcagcatggtggcatgcatctgcagtcccagctactcaggtggctgaggcaggaggatcgcttgagcccaggaagtggaggctgcagtgagccctgattatgccactgcactccagcctgggcaacaaagtgagactttgtctcgttaaaaaaaagtaagtggcagggtcgggtttgcttgattcctgtgggcatgctttttaaaatttttttatttttccatatataccaacttgtccagatatgtgggcatacttttcattgttaggctttaagatcaccaaaaaaagagaataaaaaaggccaggcagtggctcacgcctrtgatcccagccctttgggaggccaaagcaggtggatcacgaggtcaggaggtcaagaccagcctggccaagatggtgaaaccctgtctctattagaaatacaaaaattagccgggtgcagtggcaggcgcctgtaatcccagctactcgggaggctgaggcaggagaatcgcttgaacccgggaggcagaggttgcagtgagccgagttcgtgccactgcactccagcttgggtgacagagcgagactgtgtctcaaaaaaaaaaaagagagagagaatgaaaaaaagggtgataagggaccgcaaggaggggatcagatgaaagagaagctgagggaaaggctccagggataaagggagatgggaaggctaaagagaccagaggtcagtagaatttccttgttaacatgccatgtatatgtaagcccaacccttcaggtatgtgcaggagtaggtggggcagcaataactggacattctcagagtgtttaggaactggtcatgctggcactgaccctcctgcctgaaagccattgaatgctgtttccatgcacagagattctaacctttggcaggaagattggaggcaggtgagaaaggagtgaatgggggctagtgtgaagaattctgacttgggagtcaggagccctgaattcaaatcccaatactgtgtctgacttgccccatgacctccagggagcaggtgaatgccttcctcccttgggaggggatctgctgcttgtgagctgtgtgaccttgtgcaggttccttaacctctctgttcctcagctttctcatgggtaagatggaaacgagatgtagatctgcatcacagagcagtactgaggtttaaatgaaatgattgtggaaactgcctggcacagagtcaccactctgaatgagttagctgtggttgtgaagtctcacttttttcatctggagattggactccccagtgtttaagaccccctttgacacaatgtgatgggtgtttgtctcagaaag

SEQ ID NO: 13195 - DNA, 18059 bp, Homo sapiens
  misc_feature (1)...(18059): n = A,T,C or G, or insertion/deletion polymorphism (see Tables 1-2)
caaaacagtcttatgttggaagaagatgccatccaggactttcacagctagagaggagatgtcaaggcaagctgcaaagctccacaggacaggctgactctctttttagaggtgaatgcagctgatgactttaagttgaagtaaatgttcatttactattttgtaaatcctggtgtcattaagaattatgcgaaatctactctatctgtgctccataaatggaacaataaagcctggatgacaacacatctgtttacagcatggtttactgaatatttcaagcccactattgagaactattgctcagaaaaaaagattcctttcaaaatattactgctctgcaccatgtcgatcaagagctgtgttggagatgtacgagaatattcatgttgttttcatccctgctaacacaaacatccattctgcagtccatggaccaagactttcaagtcttattaagaaatatatttcataaggctattaagaaatagctatatatatatatatatatagccttatatagtttatatagctaccattgatagtgattccattgatggatctgagcaaagcaaattgaaaagcttctggaaagtagtcattattctagatgccattaggaacatttgtaattcatgggaggaggtcaaaataccaacattaacaggagtgtgaaagacattgattccaacccccatagatgactttcaggggttcacgtcttcagtggaggaagtygctgtagatgtggtggaaacagcaagagaactagaactagaagtggagcctgaagttgtgactgaattgccgcactctcatgatcaaacttgaacagatgaagagttgcttcttacatatgagcagtgaaagtggtctcttgagatggaatctcctcctggtgaagatgctgtgaacacggttaaaatgacaacaatcgatttagaatatyacataaatttagttaataaagcagtggcagggtttgagaggattgactccaattttgaaagaagtgggtaaaatgctatcaaatagcatcacatggtatggagaaatcttttgtgaagggaagagtcgaccaaggtggcaaattgcattgtcatcttattttaagaaattgccacagccacccccagctttagcaaccaccaccctgatcagtaagcagccatcaacatcaaaacaagaccgccatcctcttcagcaaaaacactatgacttgctgaaggctcagatgatggttagcatttttagcaatacaatatttttaattaaggtatgcacattggtttttctgacataatactattgcatacttaatagactacagtataggataaacacaacttttatatgcactgggaaaccaaaaaggttatttttgagatatttgctttactgtggtggtctgaagctgaactcacaatctcaccaaggtgtgcctgaacctcttyagctaactggccactgccacagtccactctgtgttggtcaagatgccccagagtggcaggcacactgtgtggtcacatccaagggcctagatatggtgggggctccaaatggatctagatatgtgagatctctctttgatttgacttcttccaacccaccattttctgggtgctgggctcatctcacccagaaagtaggacccaatgtgacagttcctgcccagttccctcctgtggtagccacttgacccaggggcactcttgatccttgcagcctcacttacacaccctatctctacccctattaactctctccaatccccactccccctgctcagcttgtctgctgcccagtgggggccccacccatgctggcctctccttttgcaagtccccattcctcatatggtttcttcagagcccctttctttggctttgaggagagatgccctcactcgcttccccaccaatcctgcccacttctacaatccattcattatcctaattgcctccgtatacagactggagtgagaggagttgatgtgatgggtgtggatacagggctggtgctgtcatcttctagtaagccctgggagaggtgtctgagcccaggtgtcagtggttttctttggaactgtgagtgcataacacttctttgccttcagccttaggccatagttgctagttctgggacaaccagaaaagccctacataatctcgtgttatgtgcagagctgagtatagagctccaggtatgatctgactcacttaagatcacagtgagtctattgtattgttgaactgttagcttagacatctgttactgtacctacatggcactagcctcacgcctagacaccgatctgaaagaaatcccctaaatgcatagagaagacttctcagctgagctaaggggctcccaccaggtttgagcctatctaatgaatccatgaggtagacagcctgcacatgtccacttggtttgatgaattgcacaaatccctatgggggatgtggttcatgggctgggaagtgggttaccctgggaaaggtctacaggacagaggcagggatggagacaacagcatggtgagttmccaacccacccacgatgataggtgtctgaggcagaaggtaaagaggctgtcacctggtgggtgtcataagactcaagtgtcattgttgaggcacatgggtaacaaagcgtggcactggatgggggtagattcttcctatttctgtgaggatcagggggactccctggctctcctgctaaaggtggctctagggacaggaagagtgtacttcttgacagggatgtcagagcactgatggtgacaatcagtgtgacactgctcacatgactgaacaaccgagaagagcccgactgtctactgaacaacgggaagagcccgactgtcaatgacggagctctgttaaatatagttaaggctattttgttgaatgaatgaagccagacaggaaagaggacagtatctttaatccatttatagaagttaaagacaggcttatttaatctctatgaagacagagtggcccttacctctgggtggagcaaaaggcaccttctgaagtgatagggatgttccttatcatcttgatccggagtggtagttacatgcatgtrtgcatatcaaaactcaccaagctgtaccactaagtgtgttcttcctcaataaaaataataaagaactacacttataaagaattttttaataatataggaaaatgtctacactataatctttagctaaaaaaaaaaaaaaaagaagccgcctacagaatggtatatgcatgagaacaattaatcgaaaagtgcatgggaaaagtcaggattgaaacatcatgttttaaaagacattgttttgatactgtgagaatgtacctaagtttttccttttttctgtttttcccaattttatacaatgagcatgtgttggttttataattagacattttgtttgtttggtttggttttgagacacagcttgctgtcacccaggttggartrcaatggcccaatcttggttcactgcaacctccatctcctgggttcaagagattctcccacttcagcctcctgagtagctgggactataggggcgcaccaccacatccagctaattttgtgtatttttagtagagatggggtttcaccatgctggccaggttggtctcaaactcctgacctcaagttatccactygccttggcttcccaaagtgctgggattataggcatgagccaccgcacttggcctagacatttgtttttaaaaataaaagattcatttgctctttttacagcccgtctcactgttgactgatattgaccaggagtcaactcaggccccagggattttcacaacagctgctgtatggcagggtttctgctcactgtgctcatgtagttggcccttgcacccaaagtgaataattaacattctccccatcctgttgacgatgctctgaaaatatggtccagaaatggtgtgagcaaggagacagcaaagcaatgcttggaacataggtgyagtgactagacatggggcagctgtttaaagacaaaaaggccccaaaaaggagggatggcacgaaacaccctccaatatgggcatggagtctagagtgacaaagtgatcaaaagttcatttcctatggggtgtccgaatgtacttaataataaaaagagaacaagagccatgcaaactgagagggacaaagtagaaagagtagcagacaccaagcaactaagtcacagcatgataagctgctagcttgttgtcattattgtatccagaacaacatttcatttaaatgctgaagaatttcccatgggtccccactttcttgtgaatccttgggctgaacccccctgtcctgagtggttactagaacacacctctggaccagaaacacaaaagtggagtaacrcacactgcaaagctgtgcttccttgtttcagcctgtgaatcctcaccttgtttcccatctagcctatatttttcaaactaacttggccatagaatcatgtagtatttagggtggaagctgccccaggtctagcacgtcatttaacagatgaggaaatggaagcttgggcagtggaagtatcttgccgaggtcacacagcaagtcagcagcacagcgtgtgtgactccgagcctgctccgctagcccacattgccctctgggggtgagtatgtcttcacatcctccaataccctaatgacagacaaacagaacatggcaaagcctcagctctgcatggtgaaagtaagaaccagcaattgccacaaacagaaatacagtgttggtccggcagcctccgggggttctgcacaagtggattaccagtgaatacaaggctatctatctttcgaaaaaccaamgttgtatttatghtattttctataaaattttatattaatttatttgttacctatttttgaactctttcaaaagcacactttatatttccctgcttaaacagtcccccgagggtgggtgcccaaaaggctctacacttgttatcattccctctccaccacaggcatattgagtaagtttgtatttgggtttttttaaaacctccactctacagttaagaaaactaaggcacagagcttcaataatttggtcagagccaagtagcagtaatgaagctggaggttaaacccagcagcatgactgcagttcttaatcaatgccttttgaattgcacatatgggatgaactagaacattttctcgatgattcgctgtccttgttatgattatgttactgagctctgttgtagcacagacatatgtccctatatggggcggggktgggggtgtcttgatcgctgggctatttctatactgttctggcttttcccaagcagtcatttctttctattctccaagcaccagcaattagctttaccttttcagcttctagtttgctgaaactaatctgctatagacagagactccggtgaaccaattttattaggatttgatcaaataaactctctctgacaaaggactgctgaaagagtaactaagagtttgatgtttactgagtgcatagtatgtgctagatgctggccgtggatgcctcatagaatcctcccaacaactcatgaaatgactactgtcattcagcccaatacccagacgagaaagctgagggtaagacaggtttcaagcttggcagtctgactacagaggccactggcttagcccctgggttagtctgcctctgtaggattgggggcacgtaattttgctgtttggggtctcatttgccttcttagagatcacaagccaaagctttttattctagagccaaggtcacggaagcccagagggcatcttgtggctcgggagtagctctctgctgtcttctcagctctgctgacaatacttgagattttcagatgtcaccaaccrccaagagagcttgatatgactgtatatagtatagtcataaagaacctgaacttgaccatatacttatgtcatgtggaaaatttctcatagcttcagatagattatatctggagtgaagratcctgccacctaygtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttktttccgtttacagagaacaataatattgggtggtgagcatctgtgtgggggttggggtgngataggggatacggggagagtggagaaaaaggggrcacagggttaatgngaagtccaggatccccctctacatttaaagttggtttaagttggcyttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaacyttcagaccagagayctattctcyagcttattttaagctcaacttaaaargaagaactgttctctgattcttttcgccttcaatacacttaatgatttaactccaccctmcttcaaaagaaacagcatttcctacttttatactgtctatatgattgatttgcacagctcatctggccagaagagctgagacatccgttcccctacaagaaactctccccgrtaagtaacctctcagctgcttggcctgttagttagcttctgaratgagtaaaagactttacaggaaacccatagaagayatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatmgtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatrttaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttcyctgggacttgggcacccggccattwcactctgactacatcatgtcaccaaacatctgatggtcttgccttttaattctcttttygaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagcygggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatgrtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtakgcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatckcagcccgcctcctgcctccgctctactcactggtgttcatctttggttttgtgggcaacatgctggtcatcctcatccwgataaactgcaaaagkctgaagagcatgactgacatctacctgctcaacctggccatctcygacctgtttttccttcttactgtccccttctgggctcactatgctgccgcccagtgggactttggaaatacaatgtgwcaactcttgacagggctctattttataggcttcttctctggaatcttcttcatcatcctcctgacaatcgataggtacctggctgtcktccatgctgtgtttgctttaaaagccaggacggtcacctttggggtggtgacaagtgtgatcacttgggtggtggctgtgtttgcgtctctcccaggaatmatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcrgtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcgkggagaagttcagaaactacctcttagtcttcttccaaaagcacattgccaaacgcttctgcaaatgctgttctattttccagcaagaggctccygagcgagyaagctcagtttwcacccgatccactggggagcargaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtytaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggkttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctmtgaggcaaccacaggcagcatttagcacatactacacattcaataagcatcaaactcttagttactcattcagggatagcactgagcaaagcattgagcaaaggggtcccatakaggtgagggaagcctgaaaaactaagatgctgcctgcccagtgcacacaagtgtaggtatcattttctgcatttaaccgtcaataggcaaaggggggaagggamatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctdtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcattatattcttgctctttcagtcaagtgtacatttagagaatagcacataaaactgccagagcattttataagcagctgttttcttccttagtgtgtgtgcatgtgtgtgtgatgtatacaaagagagagataattgtatttttgtattttcttttaaataatttttaaaattgacccttttcctgagacaaattgccagaatagtttgtatttagagatggtacctctaagagtaaggttgctggttgctgagcaattgacttgaaaacttttaaaattcaaattttaattccactactcaaaagaattgccatgttttaaaaaagagaattggtgccataagttagttgtctatgtttgaaaatgaagaagatatgcaacgtcatggcctggtcacttacccgcagccctgagttgtaggcacatcatatgtgagaatgaggatgcttttctttcatttaaaatccctccccaaaacttggctctaattgcagtcatgacaatcatgtacatttggatttatgtgcacgagtctcttaccctgagagaggacaggtgctacaggtggaggggacccgtctgggtcacgttcacattttgaacatgctggttttcagtcactgcacactcatctcccagcrcaggtcatgggcagcagatgcaaaagctgcccgtggtcctatttggaggtgcatgaaatgagcagaagacagaayagcttgatctgactagaagggcagcttgtccctaccaagacttgaaggattgcctttcatctgttagggtaaaaggtagaatgaaccaaggaagggcaggagggggctggggttagggtagaaggaaggggccatggagaagggagatccatcccataggaggaaggcagtgcggcagggaggtttgaaggtatcagcttttgtggctgacatacatgcagtcatgtcaattgctcgtttttccttttccatcttattaaatgtcttccaaygttagcacgaagaaaagctatttgcagtgttgccagcctttccagagcccgtccccattacctccccaggcccatgcctttactccttggagtttcaactcacgaccttcaggatctgactttattcaccaactctggggtgaacgtaccttctgtctccacccagaggtctctatcaaagaggagattgcatgccatggataaagtcaaagtagaggtgactgtccttaggaagagtaatgtgaaaattcataaactgggattctgtttacattttgtactccaggggttcttagtttaaatcgctctgaataaattaagatgcaatggcatttcaactgttatgattaaatttacaaatcatttattttctatcacggggagagatagagctccaaatgcaaacataactgctcaagtgttaacacttataatgaaaacataagaattaccaccaactaccctgggggctagaagcagaaatgtgaaccagaaaacaaatcatgaactttcctttttttttttgagatggagtctcgctctgttgcccaggctggagtgcaatggtgygatctcggctcactgcaaccactgcctcccgggttcaagcaattctcctgcctcagcctcctgrgtagctgggactacaggcatgcaccaccacgcctgggtaattttttgtatttttagtagagacagggtttcaccgtattagccaggatgctctcgatctcctgacctcgtgatctgcccgcctcggcctcccaccgaagtgctgggattacaggcatgagccactgtgcccggccaacaaatcatgaactttctaactgcagttccttgtagcttgttaacacatccacttacttattgtcagagtacgtggagattttccacaaccctcggggataaggctgaacagaagaggcaaaaacgtgaaaacayttcgatagctcctatactttgaaataaaattcactgtaaaagttgcttgtatttttccaaaacagagtcaacccttaatatttaagattctgtatacaaatacatatttttatataattaatatatattgtcatatgacatatatctttatattaatatgcatgcatataatatatatttccttcctaattttctataagcaattttacaagactgacttctatttgcctccttattgttactacgtggtttgataatmcgttttgtgtcattgtgattctgtcatgttttggggacttatttttgtttctctgggtggtcactagtttttttaaagcattcatggaagagtgtgaatcttttacaagctaggaagccatggcaagccttgggtcatactgcccccgcgaggccacattggcaaaccagcaagggtgttcaacttccagacttggccatggagaagacayacgaggaggcttttcacattcagctctttaatgtttgtctctgccggcaccatcccagttgtgaawaagaggtatttccacagcggctcagggtaggtagtgcacagctcacattcatcatttctgaaaaccgagaggagtctccattcggggtacaggttgatgcctgtcgtggaatgaaggttccaacacccagaccaatctctgcagtgtgctgctctcatgagcttgcaacaagatcagaaaatgttttgtgactaarcatttttcatattgcataaaatgcttcaagctcctcccttgtttctctctataatcctgtatatctgatgattgtgggtaccaagtgtttgaaataatcaaatgtgatttgatgttggtaaatttctttttttttttttttttacttctattttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccaaagtgtgatattccccttcctatgtccatgtgatctcattgttcaattcccacctatgagtgagaatatgcggtgtttggttttttgttcttgcgatagtttactgagaatsatggtttccaatttcatccatgtccctacaaaggacatgaacatagcaaagacttggaaccaacccaaatgtccaacaatgatagactggattaagaaaatgtggcacatatacaccatggtaaatttctttatcattcgcactctcctttctctattattgttattgtaactgaaccgcagattagtcactcattgcttgcagaatccaattaacaagagcgaggtcagatataaagaaaatgatttattccaaacctccttcagggaagaggtgcagcctcctgcctctaaatgcactgcttcgccaggcgtggtggctcacacctgtaatcccagcactttgggagaccgaggagggcagatcacttaaggtcaggagttcaagaccggcctggccaatatagtgaaacccctgcctctactaaaaatacaaaaaattagccagacgtggtggcgggtgcttgtaatcccagctactcgggaggctgaggcaggagaatcgcttgaacctgggaggtggaagttgcagtgagctgacatctagccwctgcactccagcctgggtgacagagtgagactctgtctcaaaataaataaataaataaataaataaataaataaataaatagtaaatgcactgctttgcttttggagcagaaagcaggcactttgaaaaggcaggggaggaagtgagcaagggcagggggtctgcacactggcatggtgcctgatctatccaggcagttgaattggcactttcataggcagaaataagttgaaaaagtggcctaaaactctctaggtgggagtggatagtgggcatgccttcaacctgcctttctggagggtgagttccatggcaaccccctgaagggtgagagttccatggagatcatgctttggtctgtaaatcagctgttaactctctagaaagttctgtcttggagcatatagttagatgaacttgccctgtaaagaatgtctggtgaaggggaagtaaaaggtgagatttgcatttctaaagggctaagtagaamgtggggtacaagaggaaaggagaaaagagaaaataatttaaaaaataattgtaacttattcccttttacttagaaaaaagggaatactcagttacattatcacctcgtttacatcaaaccctcttatggaatcctatggtttgaaaacaaaaaggttgttgaggaccagtgagcccaacccctttgctttataaatgaagagcattgcctgccctaagccccagagactctgatgtcgtgggtctggagtgggctccaacagcggcatgttttgatggtgcttcccagtggcaygccagcgatgagcctttgagtagggaaagtaggagcactcgtgactcccttcacgatcagcacctgtgtgctaataaattcacaaaagccaacatattggagtcactcagggagttttacaaatagtgaggttaaatccaacctcaaatagttctgattcgatctgcctgcattgctgccctgtggttccccactgtagaagctccccaggtgattctaagtrtagccaagtctgagaaawactgcctaaagcctgttggactgacagcaagggctgttgtctgagcaagactttgcctggcctggggtggcatgtgcaccaggaagagtctcaactttcataacagaacattcyccaagctggtttttttaaagcatgtgaatctagacttcattggcaataccaaagatctgtatttgaggctccaagtatttcactttcatttttggttttgggttatgttttcacccttcctttccaagtgaaaagtaaacagaagtgggatgtctggcgcccatgctgagcttggcaacttcaaattcaatagagaagaagtctcttgtatagaaaagggcctgtctgagatgtttctcaaataaatatagattttgcttatgtggctaaaggattcttctccccccatttccttatccctgcagtgagccatccttcttaactctttccatgaaagcattattcctgaagaactgggaactcatgccagccctgatcaggcaatgataattctgcagagaattagaatttagatttaaattgtcaactcttatacatcctggcatatggtttaaacacatgtacacacacacaaacacctcctactatttactgaagagcagatatctgataacttaatctttttggttttgagtcaagacaattcctccttttgaaactgcataccgctgaatmtaataaaatgtaattaagattaaaaataagaaactaatgggagaatttcaatattgtctmtgttcactttaaaattcctctacttaggtttactgccattaccaaagactattcaaaaatcctttttaggagaatcctaatggtttcctgacatataatcaaataaggactctgttgattggctaactcaatcttcctgtgccaaaaagcagagcccagcagagaagagggcagggacttgaaagtcagactgactcgagttccagccttggggctgtgggagcttgggcaagtgacttaacgtctctggctctcaggatctaaaaggatttccagtagtaatttggggtgttactgatacaggagctaaaaagaaattatttaggtggttagtgagggtcagagagtcctcggtaagatttgccttttaacaaaaagcagccccaaaatcatttgtttgctaacaaagagaagcctgtaaaattgagctgcagacatagataagcaagctggaagcttgcacgggtgaatgccggcagctgtgccaataggaaaaggctatctgggggccaggcatgttcaacatggattctccatcttcccttttctttgtcaaccaagtgtacagt

SEQ ID NO: 13196 - DNA, 14341 bp, Homo sapiens
tgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttscttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaawtattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgytttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacrtaggtaaccttttgtcatgagggtttgttgtacaaattatttcatcactcagctatcaagcccagtactcaataggtatcttttctgctcctctccctcctcccrccctccagtctcaagtagaccycggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttcycaagatcaagttagatctctaaaaaaggcatcatcctagcmtttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctttttttttttttttttttttttaaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggwcatgctaatattagtaagccagggtgatcctgaatttacaaaacatttttctttgggaaatttcacacctcacatgattctgtgttttyacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccrcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatmcgggatctcactatgttgcccaggctggcctcaaactcctgggctcaagcgaccctcccacctcatacttctgagtagctggggctrtaggaatgygcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccrtgccctccccrtcccactctcttcccacagcctcccctccccacagcctcctcccaccattccaaatytgggctgttctctcartttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgmccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtrggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcrggtagagccaccaggggaatcaacagtggtttctcgtgcccctcagggtcaggagcagtctgatcaaaaggagggcatccactgtccggggccattcccacagctcccggatgctgggtctggaggctgcgcccttcscctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatratctacacccrtttcttaaaagtaagccatcgtacttggttctctttaattatatattttcttacatattgtgttcatgtaggcaagtcctgtttctgctaaaagaaggtaagttctaccaaggyggtgtcatgccagctttatttcccgtggcacctggcacactgctaagcacttacatgcttaacaactagattgggaatggtgctgctctggggaagtgggcrcacrttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattrcacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgrkggcgatcccatgtgtaaaattctcattggactgtacttcgtgggcctgtacagtgagacatttttcaattgccttctgactgtgcaaaggtacctagtgtttttgcacaagggmaactttttctcagccaggaggagggtgccctgtggcatcattacaagtgtcctggcatgggtaacagccattctggccactttgcctgaatwcrtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccrtaatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacagsaagaaaagggagaggtgagctaacatttgctaagcactgaatttgtctcaggcaccgtgcaaggctctttacaaacgtgagctccttcgcctcctaccacttgtccatagtgtggatagkactagtctcatttctctgagaagaaaactaaggcgcggaaatttgtctaagatcacwtaactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaatkctttgtccttttaagtataacacatacctcaggcctcaccagcacataactacaaaaggttgtcccacttcctttctgtggctgagttagtagaacacaggctcccacctgccacatcagcagaaggtcacctcaacatgtgarctacctccccggagaccccccagatccgtaaggatgatgcatccttgatcctaaaaacattttcctgttcctggtgttcagaattggactccacactcactggtctctttataatcttgcttctggccctttgaggcctcaaagytaccagggccttgctgccaggggacaatcaccrctcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacaytccaaaggcraatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactytgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgatasgtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctmttcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaattttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttyggcagtcagaactagagcaaagataaatgatcccaggactctgtttagcaggcagtcaggaagtgtgacagtgtggtgggtggcagccccrgccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagag

SEQ ID NO: 13197 - DNA, 96128 bp, Homo sapiens
  misc_feature (1)...(96128): n = A,T,C or G, or insertion/deletion polymorphism (see Tables 1-2)
tatcaaaagatctcatgtacctcataaatacatccacctactccgtatccacaaaaattaaataaataaataagaacagggggcttgctctgcagacactgcatccagacaagtcccccatcccaccacatcacacccccttccaaagggatagcttccactcccgttttygccttcttcatctatcccacccctgcctaagcccatccctgtatctcagaaggctgccccagtaggaacccggactctgacaccttctttgctggatgaccttggtcaaccaaggttttctctctgccttattctcaacttggtaatagcaatcatactacctgctttaaagagagatggtgactaagccagaaaatgtaataaaagacttggcactaggtaggaactcaatcaattattaaaaaaacaaaaataaaaataaatatcagtgaccatcttgggatttcagacaagaagccctcggctgacctgaaagtggaaaagcttgactcgagtgtctcctttgtgccaggctttctcacacacacaacccataaaagagaggttattcttcctatttgacagctgaggcttagggaggttgactggcccaaggtcacacagctggtcaggggtaatgccaggacctaaacttccccaccacagagtttggttttaggcaagctctgctcmggggataggagctgaagtccctctggggagaagagaggaacatacaggaaatgggaagttattgagcagtgccctcgcatcacttggcctcggccccagctctagcaggaccctccaggcccagacagctgaggccatgctgtgccagccagaggcatctgtcaaggtcctggctgggccagagagcagagtcctctttggctgaactctgagagacagtctgcaacactgtggccctgagcagggagcgggttcagccagcacaccttatgggattccacagcattgggccagacccagagctgtcsccgtgctgttcacacacatttccttccatcagcagtggcagctgtctccaaagcaaatcactgcagggtcatttgtgtacctgtttcacccacgggtataaggccccagggagcagggccccatcaccctcgaatcttcccatctgacccccgactgataacagtgacagaactaggcctttctttcgggttctaacacagagaaaaggcaaaaggcacagatacacaggtttcsccaaaggtctgttctttgggccttgcgctccttcctcaggagccaaagtctcagaagcagaaaaatcctcratacccccaggatccctttgggaagtggttaacagcacaggctttgaagccaggcctcactgagtktgggtcttttcttcaccaactcctccagctgtgtcactagggaatggggcttaacctctctgagtctcagttctcccgatagttgtaactactaggcagggttactgtgagatttaaaacacgtaaagtggttggcatatactaagcactcaacaactattggtgaaacaaaaaggagaaaatcttatcctcagtaatcttcccaggaagagagcaggtttggggatgaccagcagcttgggaagggagcaagacttgctagagaagtcctaagtgggtaagcaagctgaaggcaaatattgacytgctctgggtcacaatgggcatgttttttaaaaaagacaccgtgtggaagaaaggaagaggagatatgagatacacacaaaggagaagaccactgggggtacaggagaaatacgggggtttactaagtttctgctgtgagttgtgtgaattacaacttttctagctctctgtaaagagctcagtaaagctttcatttttttaaaccaatggactgggtgttggctgttttagaggatgcaaggagatgctgagtttgaccttaagtggcctcaagggtatagagcaaccaggccatccgtaggagttacccttctgcattgtgttactgtcgtragggggatcttggaccaaaacttaagtgggcaagagcaagaatgttatttaatttctgtatcaagtccccatcccactagactggcagaaaacattagccttgggccttcttggatttccttccccacctctccagttacgtgatgccaagagaccggggagagttcgtcttgttcctgcctcaccctcgccattcaagtatggctgagggtcccctgcctctgttgtctagaggccctgccctgggacaagaacacctttcttcaaaacagcccttgtatgtgagccaggcacagtggctcacacctgtaatcccaacactttsagaggccaaggttagggggcgggggggatcccttgacgccaggagtttgtgaccagcctgggcaaaacagtaatacctccatctctacaggaaaaaaaaaataatcttaaaaacctaaaaagcccttgtatggattttctaacacagtctacacacaacctnccctttctgggtggctgtcccccagccacctctacaacagacaggcagggaggctgggcacaggctccctctcaaaagaacttctctctctacttccctcctcctgacatggggcaggatggagatgagacaggagatcacttctccctcccaggttccagttaagacattttgtctctacatcagtcctctctttcactggttctacagtcttccaagttcccctgtggatacaggctttgagcacctgaaggagacaggaaaggacacacctttcccagtcagtaagggtcrcccgaacttaggctctgtacttgttctccactattccatagtataggtcacaccatgagttttgcttttgtctgtttttaaccaggccgctgttgattgtggttattgaaarggtttatttcttcaactataaccccactccattacgtcaccattgtcattgtaatgaccccctctgccatggtcactggaacactggcactcctagtcagccagatagagacaaaggcactaaggccagaacaacatcagagctggaagggactttttgtttgtttgttttgttttgttttgttttgagacagggtctctctctgtcgcccaggctggagtgcagtggcccgatcatggctcacsgcagccttaacctccctggctcaagggatctggaaaggacttttctgaagctctgcaccagcccctttactgcaccctgcctgaggccacacccacccagtagccggtgagtgtgagaatccaatcccggaaatccagccctagttttcattttgccaggagaatggctgggaattctcagagyggggtacccttgctcaaagcaagctctcagagtctgaccttcttccagcccctagcaagagaaacaaaaggcatggctagaggtggggaagcaccagagacccagcatcwccccgacagaggcagacgtagccctgttacagacatraatgattttgtatgccacacaccgctctgcgtctgtgtcttggacatcttcccctgccagtaagcataactctattctctgcgcttgctccacagtatcccacagtacagacaatatctgttttttgtctgtttgggttttgtctgtttgaaccagccccatactgatgagcatttgggttgattccaggaatacaacccatatactacaaaggaagtcctttcatgcctccgtgcrcacctgactccacactttttcaaagtaattctcccacccacatggtgggcagtgtggtgcatgtcctcagtgtagacctaggtgcagggaaaggtggaatttgtccacagtcacacagtaagtttgtgctagagatggcaaacacgagtccccaagactccagacttaacactctcttagtcccagttgatgctcccttaacaccagactttttgtttgtttcaaatgacccagaataggcaagtgtgagggttgcaccaggcaatgtggggtgagggagagaccattaaataaccctgattgatcaaggggctgccgtgtgtagtcacccatgggatgaagtagcttggactawctccccaacttgcaaagcacattcatacccatgatctcatcttaatcttctgggttccatattattatcttttccatttagaaataaggaaactgaagtgcagaatggtaacctgcccccaaatcacacaactagtagtagtagagccaggactaggagccctgttctttaaaagtaaatatattattactgctaaaaagaaagatagcattgctgaaagtgtgaaaaaactgaaattgtaactacaaaagaaaataacaacattgcagaaaatatgaaaaaaaaaaccttgaaagcaagaaaaacaaactaaaagaaaaaatcttactgggtgaccatggacctgtcatctcatctctctgaacctcagttgtctcatttttaaagaaagggaatgaggataagcacagcgacggcagccagtacatactgagcaccgccttaccaaatttccaagtctgacctttccctgcaggcttcatgcaagtatacatatttcgtacggctataatcatgggaagcacaattttgtttgccgtttttcacctgacactatcttgtaaagtttttctattgrctacacaractcagctagcaccgtcccagcagttgcatttttcaaggttgattaacccctgtccctggtgctggatatttcttgccaccaagttttcactattttggctgatgctgcaagaaacatcttttggcttctgagaaattctccaaagtcagagactgaggcattcagaccctgaactcctgctttcccaaggcttttcacccaaccccatctgccctctgcctcagggcctgggcagagcctcggccttgctgacagcgtgctggagaggctcaccaggctcagcagcctcagggcaggctcagtgaagcttgtaggcaaaggggctgaaggggtcttycttttgtgttcccctgactgttcctaagaacatgtgcatttatgcttcataccctaactaggaaagttctccttaaatctaacccccaaatcccatcttctgttctttctacatacaatataaacttctttgggccacagtcttgtgagaatctctccaaaacgtataggaagacataatgttgtctttacaattgcacggtgtcctccaactgttaagcctgtcccaggtgaggttaagaatttcagtccctctccactgcctcacatccatctggccagatgcgtttcttaaactcctctttatcagcctggggctgtcacccattctacccattggtctgccagtcgctgtaaggttgtcatgtaccagaggcatgagtacaaatgatgggggtggggacgggggacctgaggagctgggttcaagctatgcttccctgcttgctggcactgagaccttgggggaagtcatgttactggcctcccttcagctccctcgcagcttgggtttccscatcagaaaattggaagcgattagaacctgtacttagcaagagttctgggacatcccttgtgtgaaagtgccagatacgctgtaaagcagtacctaggagtgccccacctgggaccacttttgaaaatgtccaagccccaccccaccaccaccaccaccacaaggtaacgttctgccccacttttctcatccatgttgggtggagacttgcgccatccctcggctctctacatccatccgcaccacgcccaggtgaactcacactcgggaccctgaacccgcccactccaggccttgcgggcccttctctcctcttctgcacgccccaccctcctttcccacccagactccagtgtgcccacaccccactccccatcttagcctgcctttcccctctcccccagcgcacgcgtgcatcagggcactcacgaagccaccccggcaacatctgggagcacgcgcctccacatctggaaggtgggcgcaagcgtagcagggccggtcgggttcctcgccgccccccggccccgcaggtggtggagcagggcggggtgagggagggggaggccagcggggctgggcggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggtgagtgcgcgcagcgagccgcggaggaggggacgggagagcagggagggaggaggaggcgctgcgcgccgcaccgctcggcgtccccttccggcccgcgaccgccgtccgcctcgttcccggggtcccctgccctgtgtcctgcccgccggtccccgcactcgcacaccagctcatcccttcactcccccggtgcccccgatcccgcgccaaacacagcggacgtttgtgacccatgggatcaccaagttttgcttctgcagggccaagagctgggatggggaaaagggaaagaggaggtctcagcacgcagtgggaaactggagaggggtcgggcctcaccctccgtggcgcagcttagggagccgggtcacccctcccscaaggcagcctccctgtcagccgcagctgggcctagggaagagggaagcctgtgctttggagtctgggatggaggcccagctaacccctatgctttcaccgggctgagccgcgcagtggtccgtgatctctgacagtcccaggcccgcgccctgggcgaggagaggcgagagctagggacttggattcccttcccccgccaccccacccgggcatgtgtctccagagcgcaacttctcaggctctgcgcaaagtagctccgactcgccgacgcagcgaccccggcgcccttgcttgcaaagttgggcgccacggccgggacaatcgtgcgtrcctctccactgaggtcccccccatctctctccaagaccttgactcttccagaccagtcaagtctatcaactcatagggtgtcccctgcatccccaaaacgtgttcattcactttaagaaaacaagcaaatcttaaaattcatatacagctttggggaagaaaggaaagattgtcacaaaattagatttacaagaggttgctgcagaagcagagttgctagttattaacaaagacagttagatagaaatagaaataaaacatacaaaatatgtgctcatatgtgcatcaaaaatcaaaaaagaacagcatttacacttctgttctcagccaaacggtttattaacctgatgacttgtcacacaagaagttagtatgtataatggggtaccttggcagggcacagtggcttacatctgtaatctcagcattttggtgggctgtgacaggaagaytgcttgagtccaggagttcgaraccagcctgggcaacatagtgagrccccccccgccctttctacaaaaaattaaaaattagctgagcatggtgatgtgcgcctgtagtcccagctactcaggaggctgaggcgggaggatcacttgagcctaggagatcaaggctgtagtgagccgtgatcgtggcactgcactccagcagaggcaacagagcaagaccctgtctcagtaaaaaggtgtggtgggggaggtaccagcataggaccaggctgaatgagttggacgtttagtttgtgtgtaccagccttggggatcctcatgtgtaggtgtcaccctcaccatggacccaatgcccaagcacctttctggggttcatgcaccctcttcctcctccaagtgggcaggcatcctgcctctgactgtctctccctgcaggatggggaagtcagagctccaaggtgcacatccaccacagcacatggcttcatttcccygggcacaacctgcrgtggatcskgaccttcatgctgctcttcgtcctggtgtgtgagattgcagagggcatcctgtctgatgggtgagtgactgtctgaggactcaggaaagtgaatctgctccagggtacttcctgaaaggcccaaggagatcctagctcacctatattccacaagcccatgtcttttgttactacatccagcagctcagtgtcttctatgtgccaacctctctgagctgggcactggacgcaagtgagtcccaggccctgccatcagtccaggagagcagagggaacacggacctgcatgccaagtcccagtgaaataatgctagagcctattagaatgccacaactccagtgaaaaatgtctggcctcttctacaacctgccggagttaccttcttggaaaaaaaaaaaaatctaaccatgccacccactcttgcataagacctttccttggttctcagctgttttgaagatgtggtctcagatcctcagcccaccattcaaggtcttcacagtcagccccacctatctytggcctcattccccatgcccaccttccgtttgggcctcacagcacactcctcacacctctgctacagcacagatcacactgtatgttaaagtttatgtctatttgcaaaactgtcttcagagtcagaaaggcctaagagttagaatctgagtcttgttcatctttgtgttcacagtgcaaggcatgtgataaacataaacattattcagtccataaacatttattgggtccttaggagaatgaatgaaaccatgttacaaataagtactctgggaggtgagaggaaggcagaattgggcaagctccatggttgagagggctttggagcggagtctggaagggtgactaggcttcagacacacagaggaggaaggagagagagaactggtggtgcctgagggaagggaaaaggcaccaaagagaaaagcaggtagggctagggagcagcgcaggggctggagcattaaacacaggctggggagcgatggaggctgaggctgggaacccaggttggggcatctcaggaggactgtgaatcccagmctgcatgtttgggtcggatttggtcagcagtttggaacagaagagagatgtcatcagcataacacttttaggtgggaacctgaggtgttcagcgcaggctggaggcagggagaatctagaggtataatagaagcaggacttagcattgactgcagtagtctaggtgagcaataactgcagacagaaatggtgtgtcagcagtcagggacagaagaggagcgggagcagccatctcactaaggaagaatcyagtaaccagcaaggatgagagactgccaggagagggagtggtggaggagagggatatttggcttgagtatctgaggtccagcgccccctgagctggaatcagattatacccagactgcactcctgcagygctgcctggctcctgtagttggatggcaggggataggctccctcatcctccctcccgttccccaccttcccttccccaatgtccctgcatcctggcttcagcagtgatctctaaaatacctgcttgacttggaggcagcagctctgcctgcttattaaagtccctagaccagcaagaagaccagaaggcatactgctacacaagcacgtgacaagtccgcctccacccccacccctacaccccttccaaagtagcacaaatgccacagtgagccctcagatgggaaatactcaccagatggtgacagagaaagacacctccgcccttggagaaggaagacctgggtcttcagtgagcactgctgctgtgtaccagctatgggactttgcacaagtcattcaggctttctgggcctcataagcatttataaacatacgataaaacattttagttgccaacttaaaaatgtgtgagaaagtataaggtgtttcaaaattatttcaaggagtaaagaggcaagagttttgaagatccctgggcagggtgttggctgttcccagtgtggccattcatgactgctctctggccttatgaaacaagcatcatagtccctggcttgcctgcttcatggggctgtggagggtgaaattcgagcatggacagggtgcagagcccggagtggcagagcactgggtagactgtgtattcccagaatgtgggaaactggaatgaatcggtccagggatgccctcctgctggctgtcagcagcccctcctgtgtgtggctgtactgcttcagctcagtgcaaagggccatctcctccccagggcacagatcagctcaagctgagtaattgtcatctggtctttgtgagctcctacccccaggcctgagtgaggggcaggaaaagagcagacaggagaagtcacagacccttgtgatacctccagtctaatccagcctgggttttcagagctgtctggaaatwtagggggcaggtgggagggggctgattaaggcagccctgatttgatttagagtgagcctcatttagtgactaattaagccatcttaaacctgtagggcttcccctcttcctttgggtattatttctttctgtgatgttctgaattcagaacaatcaaaacagtataagttagtgaagaagatattttttaataactacaatattttcccagaccaccatacactggataaagcctgtrtataaaactttacctaatttcttaactaattgaatgtgtwttatttaacaaagcagctaaaaactattctatgaagccatgtcatgaaatatttagttcaattatggttaatcctcatcttatttcgtcttataaaattttaacatttctacctcctattgcaaaaaaaagcatttatatcagcatataataaaacatgtctagatgtcagcttaaaaatgtgtgagagagtagagggtgtttcaaaattatttcaaggagtaaagaggcaagagttttgaagatccccaggaagggtgttggctgtgcccagtgttgccattcatgactgctctctggccttgtctgtcttgtaccttctatattagtttgaagaccttttttggagaatattcactaaagaatatcaatatctaccatttcattaaaaaagaaatgtggagtttgccttttcaagttggtttgatgcttattgatgttttcagggacccagcctcttcccatctttccataccatcctgtgtgtgtgtgtcagcctatcttccccatggtcacaaggtggctgcctagctccgggtattgcttagcatgagcagagagggcatgctgccgacatgcctctcctttatgacagagatcatyctttctttgacatctcactggccagaatacgtggaccaacactggcaaaggagtatggaattgcatggctgcttaaaccaatcaccatccattccctggggctgggtatattgctgctggagcaaacctgtggtcctcctggcacagaataaggggaagatactctttggtggacagcccacattgcctctacacttgcacctcagtcccaccagacccactgaggtcacaggatagctctcctcatgtccttcctccttctctgttgaactcttatgtatccttcaaagtccagcctggtgccacctcctctgggaagctgtccttggttgcccaccccctcctttgtgctctctcagtctctgtccatcggcagtatcacttccctagcctgctgactccaacagttagctctgagcatggcagccccctccataccatcagcttctcaagggcagggacccttggcacactggatagaagtagcctggtgggcaacagcagcactgaggcagcargctgtagcaggccatctgggaatggagtgggtaccacagggctggagcagaaagggcaggctgggcagatctgataaagtggctggaggccacatagcctgggcctttcgttccaggctgagcagagtgggttttgctgtctgcaggagggagctgtggaagggcatgatcacgaccaactaaggtgaccctcctcaccaggcccagggaagactgaggcctggaaggaggcwctggctgcctctgggtcttacccccaggccacagtccacccacttagaggcctctgtgagttaaggtggagagactatgagctggtattgactgctccattccccatcccgagagaggagacaaaatcagtgaccttggaaatgcctcttcgtgcctcagtttcctcaccccataaaatgggagactaagagtacccactcgatggggtttaatgaagattaaatgggttaacatatatcgcatgcttagaacagtgcctggcacaragtaaatgctccataaatactgactctcatcagtttgttatcacagcctctggggagggcgccagtgctgacttatgctgttcgtgttaaatggggctgtcactgggtgagttgtggcatacaggcccctgcactgttcaagagaccccagcaacccttgtgcttagggctcagcacatagtaaggcctccagatcatatacccagctctactccatgtactggcagctctgcccagcccataccccaaataygcccattaactaaagggccctgcagcctataaagtgatgctataaaggttcagtgttcagcctttgaaattcaaggcctkggctgctctattgcagtacttagcatgtccccatcctgtctgtttctctctcccatctcagggtgaccgaatcccaccatstgcacctgtacatgccagcygggatggcgttcatgsctgctgtcacctccgtggtctactatcacaacatcgagacttccaacttccccaagctgctaattggtaggtgaggtgtaggagggaggggcagtaccttcattcatttcttcagataatgtttactgaggactcattatgtrccagctattgctctaaacagtagagatttggaatagaaaaagaaaaaaatccctgccttcatggagcttacagtctggtgaaggaggatagacaggcaaagacagtgaataaacaagcaaacaaataggtggtggggatgctatgaagaaaatcaagctgagtaaggggtaggggcaatgacaawgttgctatctacacaggatggtcagggaagggctgtggtaactgtgggcmtgcagatatttgggggaaggtattccctgcaaggggagtgacaagtgcaaagtcctctgatagggatagatttggcaaagatgtcactgtgggcaaagccaaatgagcaaggggaagagtgggaggtgagggcaggmgtcaggagaggagcgagcaagagtcccaggctctgggcctgagagcctgggtgaactgtggcatcaatawctgatgtgacagaggagggggaggtgggctgtggtggggataaagttttctactgggggcatatcgagtttgagatgtcacagagacagccaactcaagtgtcaagttgggctttcatggggaggtcaggacaggagctacactttcaggaggtgggccttgtagatgacatctaaagcttgagcctggggctggctgccgtggctcacacctgtaaccccagcactttgggaggccgaggtgggcggatcacccraggtcaggagtttgagaccagcctgaccaacatggagaaacccccacctctactaaaaatagaaaaattagctgggcatggtggcacgcatcggtggtcccaggtactcaggaggctgaggcagtcaaatctcttgaacccaggaggtggagattgtagtgagctgagatcgcgccactgcagtccagcctgggtgacagagcaagactccatctagaaggaaggaaggaaggaaggaaggarggarggarggaagggagggagggagggagggagggagaagaaagcttgagcctggatgargtcacctggggagagaagagaaaggctctgggaccagagcttgaggtttgctaacatttagagagactcrggaaggactgcccacttagagcttctgagatgttaaatactgcaggactggggtcccaggcagaagcaacaggatgatggttggtgtttactgagcatgtgccatggggcaggctccatgccatgttccttacattcattgtcccacaggctaattcccccagcctccttattggtattgttaatatccccattttccagtgtggaccctgaaactgagaggttaaaaataataacrgtaaatactcactttgtacttactgtatgccaggccccatcctacctatgtgatatattaattcatttaatccttgcaacaactctatgaggtaggtaccattattattttccctttacatatcagaaaactgaggctcagaggttaaataactggcactagtctagctcgtcaaggggcacagccgggagtctagcatctgtgcaatctcctaatcatttctgagactgcgtgtctaagggccctcagacttcgtccttggggtaaaggtatcaatccgcaggtctgcctctgtgttggggttcagcctgtgtgtctaaggctggggctgtacatctggcagttagactttgttcacactatgtccttaagtcagactgatttttaggtatcacagcatcgaattgacatttggagtctggcacactctgtgctaagccagtgacatcatggtgttgtcagggagtacagggtgtttcttgcactagtcacaggtctgcctttctgtagaaggtgggatctgagctccattaggattatccaggtgatccccctacccctagcccaggggyccccacatgagtatgaatgggagctgggggaagcaggttgagaggggagatgttaaatacaggcttcagagagccaccctgcttccatttctgaagtagctccttgtctgtagagaacccttcattaaccaccagggcctggctgaccagtgtcctctggaaacaccctgtctggacatctgaggagttcattttctcattctccagcaaacacataatgttctctctttaaagcacaagttatcacccrtggatggatttgtccttttctaaggaacaaagactaactccctccattccccttgttggagttatctccccttgaaaggacrctccacagagccagaaattctagaasagggaaaagtggaggggacgtgcctgtgaactgcagggacagarggmaatgggtattrggagaatggccrgccctccaaggggctgatgtctggcctgggtatggagtcccacagaaaggggacctgtgatgcagcttacattgtcccgtgagggaaccatgatcctggaacccagatgaggccaaggaaatgttctctgaaaaagtcatatttgagctgagaactgaagraactaactgggagaagggaggaaagagtgyttcaggcagaggaaacagcatgtgcaaaggccccaaggcagaaggaacaaaacacattagaaaattcagaagaagaagagtggcgtgggtgcaaagtggaggggagctggactttgggttttgtttgcttgtgcccaggctggagtgcagtggcaccaccttgggtcactacaacctcygcttcctgggttcargcggattcttgtgcctcagcctgctgagtagctgggaatacaggcgtgtaccaccacactcagataattttttgtatttttagaagagttgggatttcaccctgttgaccatgctggtcttgaactcctggccttaagtgatcaggtctcaacttcccaaagtgttgggattacagccrtgagccaccrcacccasctggaaggtcataccacagatgttkgcctttatcccaacagcaatgggaagttgtgtgtgtgtgtgtgtgtgtgtgtgtgtgtgtgtgtgtgtgtggtttaacatgtttaacataaaatttatcatcttaactgtttttaagtatagtgttctgtggcattaagtatattcacagccgggcatggtggctcatgcctgtaatcccagcaccttggcaggccaaggcaggtgaattgcttgagctcagaagttcgagaccagcctggccaacatgscaaaaccccgtctctacaaaaaacataaaaattagctgggcgtggtaatgtacacctgtagttccagctacttgggaggctgaggtgggagtatcatgggaggctgaggagagaggatcagttgagcctggaaagtggaggctacagtgagccaagattgtgccactgcactccagccaagttgtgccactgcactccagccaagattgtgccactgcactccagcctggacaacagagtgagaccctgtctcaaaaaaagaaaaaaaaagtatattcacagtgctgtgtagccatcaccactatccatctccagaactttttcatcttcccargttgaaactctgtactcattaaatgataactccccatttctccctccttacagcccctgacgaccaccattctacyttctatctatgaatttgagcactctaggtacctcatctaagcggcatcatgcactgtctttttttttttttttttttttgagatggagtcttgctctgttgcccaggttggagtgcagtggtgcaatctcggctcacygcaacctctgcttctctggttcaagcgattctcctgcctcagcctcctgagtarctgggactataggtacctgccaccaygcctggctaatttttgtatttttagtagagacggggtttcaccatattggctaggctggtctcaaactcctgatcttgtgatctgcccacctcggcctcccaaagtgctcggattacaggcgagagccaccttgcctggcctatttgtctttttatgacttgcttatttcactgagcataatgtcctcaaggttcatccatgttgtagcatgtattgaaatttccttcctttttaaggctaatattctactgtatggatatgccacattttgtttatctattcgtctgtcagtgggttgcttccacctcttgactcttgtaaatagcactgctatgaacatgggtgcattgaggggttttcracataatcataataattgctttatggagaccagcttggaggagaacaagatggggaggaagtgtggaaaccaatgagaaggctctcagggtatagygggaatacagaggacgcatgatgatgcctggacttaggtggtaccacagggatggagagaagtagatagaktcaagctatttaggacgtgaaatagacagcatttgttaatgggagaggtgtggggcgagggagaagaatagagggagaaggaggagtaatgggagctcaccagcagcccccatgttatgcctctttccttccttttccctcttctctcatcaggcattcagcttttgctgagtacttctgtgtctgacaacaggctgarcactcagcactgcaggacaggactatgcaaaaaacctctgggcctagtcctgggtgcactgctaattccctgtgtgaccttgcacaagacatccaagctctctgagcctcsgattccccacctgggcaggaagagtaagtccctgcctaagtcatagggttgtaatgaagagcaaagcagaccatatctgttaagtgttagggacaagacaagcatgaggcatatyttcaagtctcggctcctgtaggcagctctcactaagggctaaagggcttctgatgcctgggatagaatctgtccggcagagtggagtggaggcagggggacagccttcagctgtgraattcctccagtcctagagaccagcctgagctgggggacattattccagtcctgaggcrtgagagcagaaggccgatgcttctgccctccatsctaatgtcctcctgcmgggacccaaggtggatggcatcgatccccccgggtgagctcagccctgggcgcatggtggggcccaacatctcaacctgtttcctaaccctgagccaggcaggacagatcccagatttgtgcccaagagatgctctggcatccatgcccaggcccacatagggatagagggcagggtgaaagtctctctccctcactcgggtcctctggagaggggctctgtgtcatgaagctgaccttatccgcatctggtctaggagggaggagggaaggagctgccagtgctaaaatctcccccaccctcaaagggggacttcacaggttattgctggttttggttgttggaagctgacagtgatttattggcagattgaagtgagtgtgtgtgcgagaatttaggatagaatctactgatagcttctgaggtttaccttccccaggtcttaaatctggagataataaaaatataacagctaatgtccaaagagcacccgctgcgtgtgaggctcactgcactaaatgctttccatatgtttctcacaagaaccttctaggtagcactattatgattcccacttaatggatgaggaaactaagctctagaaggctaagtgactaatccaaggtcacacagctattatgtcacaggctctgagcccaggtgtatctggctgcggagccaccaccactaacccctgtataacgctgcctcacagaactgtggctggctctttccgtatcccccatgcccctgctccatcatcatgctgtggtgggctctgaactgtgaggacagggatccaggctttcaccctctctctgtccctagctgccagtgcacttgggcaaggtcacatcctatttctgggcctcagtttcctcatctgtaaaatgaaaggctggattgaatgacctttaagatttccctcacttggaaattccacaagtaagtcattatagcatggagcttgcatgcatgggctccagcgtcaggccagcccagctctgccagttaatgggtgtgtggccttggatctgttacctaacctttctgagcctcatttcctttgtctgagaaattgggggtgacggcagtgtactttctttgaaaagttatggtgaggaatagataagatcatgtgtttaaagtgcttacttggcacagtgcctgtaacttagttaaattcaataaataaatttcccattcttcccatgatcatttatttttaagggacatttgtctgaccagtttgatttatgagattattggtgtttttcatgaatgttaagacgtacgtgcgtcatcttagagtcatgtactctgatatattcacacgtgcacatccacttactcggaaatgtacacacccaggcacgcttattctgtctccttctctgccacatacttgcacacattatgtgagtgtacacacatgatgcacacacgtctctgcgatcttccatctctcctcggcagccctgctggtgtattggaccctggccttcatcaccaagaccatcaagtttgtcaagytcttggaccacgccatcggcttctcgcagstacgcttctgcctcacagggctgctggtgatcctctatgggatgctgctcctcgtggaggwcartgtcatcagggtgagggtaagcaggccacytgggccagggtggggtgggaagcagaggctctggcctctgtcctgccctgggttcaggcccccaccctgcttctcagccaaactgagaagggatcagcttgttttacccgcccgtgtaaaggggagtggggccgtggcggaaatttcaggatagacactgcatctggcccacrtgtgctctaccccaggstcccagagggagaggggggtgatgggtgtgttcgctgaggttggcggatractttccgtagaaagggaagataagcatcaggcactggcctctcctactttctttcttcgggggtgggggactttgctttaatgtattcatatcgtcacgctsgtaaatgaatgagtaagtgttttgttttcctttctgtttgctcccgcctccctctctcttcctcaccccagactccaaccttccccttcccctgcccctacctccccaggcagcccagactaatgaactcgtttgtctttcccatgctttgtttttattagtataataccatatgtgtctgtctaaataaatacctattcaggttttttcctctcaacacaagtgaatatgtaggtttcccccacggtatttatcttgtaagaatgggatcatattatgcagttttctgcactgtgcttttctcacccaacaawtatctcttgggactccctccaagccatctgatatggctaattccgttttcttaatggctgcataatattccatcgtatggatgagccataatgtgttcagctatttctctatggatgggcatttactttgttgccaagttcttgccttcatgaataatggtgtgttgaacatacttatatatttatgtattgctgcttttatttctatgggagagagtccaaggaatggcgttgctgggtcaaagggtctgtgtattttaaattttgatcagtgttacatattgccttccagaaagactgtaatctgccagcaatgagtgagaaaaccctttccctgccttccaaccagcagtgagggctacagccctttcgaacttggactgcctgcatttctctgactcttctgcttttagttggtgatctgcagggcacaaagctccttatgtgtccccccatccagtgaccctcacaggaaccctgtgatgcaagcaccatcccctttatagatgaggaaacattttagatgaggcttgtccaaaaacaccttgctagtaagtggaggaggcaggatycaaaaccaggtctgcatgacttggagttctgtgaactgtatatgaaacatggtggtatccttagatctgtggagaagatagcatatgagagattcctgctcctccccaacccaacctaaacccaacccagcctagccatggggggttcaaagtcgacctcaatgagcagttacaaagtcaggatgccctgacattggtggccaagaagtgttggggaatccttttcctggtaataattacaggcgaaagatggccccatctgttagagatcaagtgtggaatatcacaaccccagatccttgctggggcaaggtagggagtggtgagaagttggacttacccatcccccatggcccatgtgccccacagagatacatcttcttcaagacaccgagggaggtgaagcctcccgaggacctgcaagacctgggggtacgcttcctgcagcccttcgtgaatctgcygtccaaaggcacctactggtggatgaacgccttcatcaagactgcccacaagaagcccatcgacttgygagccatcgggaagctgcccatcgyyatgagggccctcaccaactaccaacggctctgcgaggcctttgacgcccaggtggtcagtgggggcacagccacaccatctattcactgccttctggtttagggtcacagagagggacctcaaagggcattaggtcaaaatcctgrtgggacaagaggggaaactgaggctggtgaggggaagaagcttgccttaagtcacacagtgaaccagggacaggtgcagggctgaggattcataggacaggcacagttggaatggcccttaccgtttaggtcgtctagtccaaagtccttatccagatggggaaactgaggctctgagaagggaagtgaccccactggactctcacatccctgtgctctttcctctgcagcttactgactataaaggttggagtgttcacttgatttggagcaggggtgttagtggcctgatccttatggtaactctatgagytgagccagacaggaatctccccatatcactgaggagcaaattgaggccctgagaaaggctgtgacctgcccagagctggccacagctggcaggcggcagaggcagyctcctggctcccagtccagtgctccttcacttcctctgccctcgcaccagggcagttgctgaggcagacacggtggcaggtggtaatgagtgagtgtggcacatggccacctcctcattccagtgctgtgctcatcacatagtccctgaccagctgtgtgaccttgagcaatcatctggccttagtttccccatctagaccatgttggtgttgatagggccctcccaactgtgcacttgctgattccatgatctcttcctggagttcacctatttgcagaggatgtgacyrctgggtttccccagacaacaggagctaggggcatcctgggaggmtaggcccagccrtgaattagccctcaggcactctgacctggccatggtctctctgggcagcggaaggacattcagggcactcaaggtgcccgggccatctggcaggcactcagccatgccttcgggaggcgcctggtcctcagcagcactttccgcatcttggccgacctgmtgggcttcgccgggccactgtgcatctttgggatcgtggaccaccttgggaaggagaacgacgtcttccagcccaaggtaggcagccccaggggtagggtaaggcaccctctagatggttttcagttgtttctgagagtgcaacaggccaatgtgtgtgagccrtggccacactggagtggctcctcacacatgcgcaaagcccatagcagtatccccaccacagaatactctacatctggtcaacagaaatgccagagggcgagcctatgccccaagggtatcctactctcctctcaccgtcactaccatagtacctctcccggtagttaggtcagtccgaaaactgcaggaagtgcttttgtttgtccagtgtctagagcttctgtgacttggatttgttggctttcagttcatgtcatcttagtaaactctttaaaagttttcaagatctgtcttcttcagtcctgtaaaggctggcacttgagctttctgcaggggcatcttgggagctactgtcagaggagagagaagtgggaaaccctcacgagtggagctttgtctctccccactccaaatttcattcaaagctgcccgtagttttattaatatgttggacttttccattaaaatttcttttttaagaaaagtttccatggcttaaaaaacactggagacttattagactagattatatccaatggccttggcagttgtaacgattctgcaaactgaaatttgttggagctagaaaacctttccccggggttatttgccctgcgtggggccgtagcatccacttcgggggctgggcagactgtgctctgttgtctgtttccttgcagccgtttaggtttaaatggccacaaaatgaaaactttttcacccctaataagtttcagagttttagtttccaagtgaggatgtcattataacattttaaccacagacagtctgaaaataatgcagagaatggggaattagggtttttaataatttatgacaccctttgcgtaacatttgttcatctcatgagctccaaaatcgcagccagcagttaatcctcaggaggtttatgttcatttttctggagacataattagtcagctgaacagttttggccacagatatgagatacgttgagtctgatttatgcagcaaactttcattgaacactgctgtgtgccaggcctgggttgggctgtgggaatatgaaagcaatagttatgatgaggatgattaacaatattaacagccacttactgaccacataatacrtacctggctgtgtgcaggagttatccatgtgttatttaatccctaaaactatcctttggcgtgagtatattttgcaacatctttactgtggtatacctcaaatactgtacagtttatgagatgataggtattcttatccccattttacaratgagaaagttgaggctcagaaagtttaagtaattttccccagggtctctcagctagttaataacagaggcagaatttgaacacaagactcactccacagtctgggcatttacagccaggaagctaaattgactattattatcaagccatcacctctggctccaaggattatgaaatccaacagtgaggagagaaatcaaaataaaatacttttatgctatgtgttacatgtgactcttaggaggaatattcagggaattgtgggaaaagatagtgattaacttagccagtggtcatgaacagcttcatagaggaggggatgtttgaaaggggtcttgacggatgagtaggaatttgccaggctgccatgggaagatttcttgctcaaccaagaatgcaaggaccacttttgcttatttaaactttgatggcttttgaagccatatctggctttttgagcctctctactttacctggcccataaaagagaggggaagcggctgcttctcttgtctacagkagtgtcacctttggctctagcctgaccataggctaccccagaatacccccattggcgatcctgaagcagcatggagccagttgttaatatcagggggaaatggcacaggccagagcccttatcagagtgtccacaccacgctcttcttcctgtgtttcccaaaacccttgtgggattctgctaaggagagagctctgaggcaggacgtgccaaagagatggcgaaagcacttagaattttagttcatctgaacgttatcattgccgtttttttctctttgtttatacacaaaccctggggtttattaccgtctcattggaatgctcttgtcccagttacttagcacacaaatccctgagacagatggccctgcctcagtggcagtgggccttatcagatttaatattttttccctgcagcccaaacacaatcagaaaatttccgacacagaaacaagagttgaaagtaaatatagtctccagtgtccgcaacaaagaactctccatcatgtggttgcctgggatgtggcttaattctcatgtgggcttctgagctcagaaaatgggggaaagggatcatttactgagatcatttggttcatctcccagcccccaagccattctaatccagagagaaccgagtgctattctggtctttatgaatgacaaagaaggaagctccctagctacatgttgcagtgtttcacagtctgggagaggaagccgttttttctgcccagcctgaatccatcctgcagcagttggcacagcgaggcacctgtggtttattcatcatcactcttccttcctaagatactcagagttggcaagaaacatgtyatccttggtatccgcaaggacgaacatttctgatgtcctctttagttactgaaagtgtctgtgacttgccagatctttgatgctcctgtcaccccgctgccactccccagggaaagctgggacccaggttgggctctgcctatgatctatagctctttccagcctcctctccaacccaacccctactcccaatctgtcacctcccatggatgccactgatctggctgaaggacaagagaattagattcataatgagctgctggtgtctgaaacctgccagcactgccctgggctatcagttgagccaaaggaagaaggaacagtctgggtttgatcgaagggctaaagcttcaaacagcctctaagtctcagtaggaaaatgtgtaggtttgggagggtgtatgtgtttccgaatgagttcccctaagaactgcttatggttctatatgtgtgttctgtttgtccctgtgtcttttggtgtgtctttttctgcgtgtgtgtgtgcatgtgtgtgtgtctatgcccccgtttggattgccatatttgtggctatcattatgagtgacttaatgagtgtatatgcattggtgtttctgtgactttgtggttttgatgcatgggctggcctcttcataaccatgtccatgcagctggtctggcctagagtacctgccttcaattcactagctccttcttggccatcaagactctgctcaaatgtcacctgctccagggagccttcacctggttgaattagatgccccttatctgtgctcacataacatcctatcaaagcgccctgtttctttccctgacttgatcctctgtcccctattgcctgacctctgtgtgcccagcactcagcccactgcctgacacccaggagatgcacgggaaatggttctgcaaagaaggaataatgcagcaattactatatattgagtgcttacacttactgttttttcacatgcactgttacattgacttctcataacaactctctgaagtcccttcatagcctcaccttacagatgaggaaactgaagctaagagaggttgaggaacttacctaaggacacagtggctaatatatgatgagtcaggacctctaagtccaggctsttaaccaccrtgtcaaacagtcttgtatgaatgggtaggtgtgttgrtctctgggtggccaaagataattttattctttacccagggcctcccggggctgggacctacggacaackcaccttttgacacctgccaaaataggaaacaagagtccaagtgatcccctctcctttaagcaccagagaacatgtgaaggggacctttccaatcatacctctggcctggcagagacaatggggctccaaactgtagagtcgggagtgctgggttttagtcctacctctgcagctaactcatttattctcctcagcagtcacattctgcaagcctcaaatgcaaaatgtgtaataacttctgtagaaagtacatggggrcatgaagatcattggcttgattgcttttaaaaaatcggtattgagcactactggggaaatccctggaaacaaacacaattcttccctgagagcttgtgaaaatgcaagactagggcctatgattttccaaagcattttcttccaccaagtgtcargttgtaggtccttggtcttttctctcttgccttggtacctkcagggtgctgaccagtgctatcatatcccctccccgtttcctaggaccctcttctcggtagactccaacagggcctgccttccttgggcagcatggcaggcctcttggctagtctagtacccacttcttttttttttttttttttttttggatggagcctcactctgtctcccaggctggagtgcactggcgcaatcttagctcactgcaacctctgcctcctgggttcaagcaattctcctggcccagcctcccaagtagctgggattacaggcatgcatcaccatgtccagctatttttttgtatttttagtaraaacagggtttcagcatgttggccaggctggtctcaaactcccgacctcaggtgatctgcctacttcagcctcccaaaatgctggaattacaggcatgacccaccacgcctagtcaggtacccacttyttaactgaaacttagctattccaggttctatcccttttaaaccaactctttgaagagaggtctaataatgacccaatgacttatagctgcagtgagatttttattttaacaggtcacaaaattctcaatccacaaaagtagatttctgaccctaggttattttgttgggggcggagagaggaagtcaaaggttttgcagcctttagagctgcaaaaccagaatttgttgttttgttaaaaatgcacaaataccgacgagtatatttaagtaacacccatagtctaacgaacaaacatgatcagttggcttttccagccctcattctccagcctgtgtgttttctgctcattgtaacacagcgtgtgtgtggcattccatgtttctccagagctttcatgagaatcagtggtcttggatgcatagtgttcccatgagtaccttaattacctaaccattccctgtggttggaaatttatatgggtttttgcattctccttctgctctgaccccaaaataaatgtctgtgttcatacagctattaccttatgtgaaattattttctttgggataaattctcatgatgtgttgttgctttaaaatagtggactccagtctccagagctgcgtctctgcagaggacagtgggacagaagaatcccagggcatgttaaamaggaccgggtcttcctaaacccacatgcctatatttctgacccagtaccagccagsggggcaagtttccatcccccacaagtcacaaacctgtaactgacactaggatgcttaaggtcaaaggcctgracgaggcctagacagtgggtctggggtagtgtttttgacatcactcaggttcatgttcacatgttgtccccttaccagcatgtgaccttgggccagccactaaccctactgaaactcctttttttcatgtatgaaatggggctaataatggtaccctcctcattagggtattgtgaggatagagttttgcacctgataaatattgtctcctgccccttcctcccctggaaattcaggtctctccctgcagcctaattttaaggcccatttttctgcttccagcccacccctgcccttctaccttcgacctcctccctctgcctctccctctggtgcactggcaaatgggacagagagcctcggtagggccytcctcttagagtcttgcacgcatccctcagtggtctccctgtggctgcttcctgctgccaccaacagatacagacccctgtcgcacagatcatggtagagacagtggtgagcaggaccagacagctccagggagcagtgagggctggcttagagaacctctgttaaactgagaggccaccatcaggaagctctgatccaagatccaggaatccctgactctagggaaaggcctccaatgagagcctgggccctctctgcctgattctgattgtggatgtgccctcaaactccttctcatcactttgttccatccctctttaccctgcagcagctcccacaccctgccaaacaggatgcacagtccagggcagtgtctgagaaagagcagagatctgtcttcatggaaatattgatgtggctctgctggggagcaatggatttatcaagatcaaagttttcctgggagttattgatgcttaatttggaaatagacacactgttgatccctggtatctttagcaacaaagttaaaatgtttgtttttcttcactggttgccatctgagatcttgcyggaagtacacaagagaaccttaaatttaacaggaggccctgggagcccatgaggctggcgggcttgggtctgaaatcttttcagtctcttgtaagtgatgagctctcattctctcctgagagctctacggtgccatgttttccactggccttttctgctyagtaattgctacattacaggctgttggtaagttcggaacaagggagctgctgattccatttctgtagcagagaacatgcaccgtgagacttgttgtaccagttcaggttttaggtgctctatttattcttgccccattcagaatgctctcccctgggtctgtggccacaatgctaagagtcatatttatgggcctgcagttgtaattgggccccattctgttcccccaagtggaaagatgaacagggtgtaagcaaccttccctgtagttagaaaaacgtttagttggatttatcagtctgatttttcactcataaacaattgcacaagcctttgcaagcccagagggtcttgtaataatgatggccgtggtccattatggcacagtgatgtgttctacggtggtcattttgctggcaatgacagtcacctctgaacttctctttccaacagacacaatttctcggggtttactttgtctcatcccaagagttccttgccaatgcctrcgtcttagctgtgcttctgttccttgccctcctactgcaaaggacatttctgcaagcatcctactatgtggccattgaaactggaattaayttgagaggagcaatacaggtacttggatgattattttttcactttgccataagaaccattattaggaataatgtccatgagtgttattcatcctcatggacactcaagaataattctgctgtaaatttattttttgttgcccattaacgatgttttaaaacagtaaccattgacaaggcagtgtgggatagtggaaaatatcttgggctgaacttgggagacagtgtagctctggctctggttctgccttggactgggtctgaaaatccagctgctcagcccttggcttgaaagtggtagacgtcactaattgatcacagcactctttctgaccaagggtaaatgcaaccttggaatcctctctamgtggctgttccagagttctgctaccagacagtcttctttgrgtgtgaaaaaaggaatgtgcttgacatacaaggtctagatagcctctaagacagggtcccctctaagatggggtattggtccatggcctgttaggaactgagccacacatcaggaggtaagcagtgggagcaagcattactacctgagctctgcctcctgtcagatcagcggctacattagactctcataggagtgcgaaccctattgtgaactgtgcaggcaagggtctaggttgtgtgttccttatgagaatctaatgcctgatgatctgaagtggaacagtttcatcctgaaaccatccctctcccccaggtccatggaaaaattgtcttccacgaaaccagtccctggtgccaaaaaggttgaggaccactgctctaagttctatttgaacccttaagtcttgctcactaatgagagkgacctatttggtctgttgggtcacttaagtctaggctcttggtcctgccttctgtgatttccttcttagagtttctggaaagatgatcaaagccagggagtgttcagggcccctctgaagaaggtgatgatgagagttgtccaagtcccagggtcttcactaggattttggttcagctatcagactagagagacatcctgattgagagtagtttaaatgggatagaagtttgtttattcttcagatagagtcagggctgacacaggagctactcaatgatcagagacctggcttcttctgtcatgttgctctgccagccttcttttgtgacttttgtctccatagccatggtgggtattgaaactgccactatatttacatttaaactagccagaagaagggacaagaggagggaacrcattttccttttaaratggtaatacctgatttgcacataccctctcgcatcccattggtgagaaagtggccaaatggccgtatctagagagtctagaaagagcttggtctttattcttgayagctatatatgcactgctagaaattctctgtgcaaagaggagaatgggcattgggaataactagatgcagctatgcctagtgatgtccatgaagttgtggtaaaatcctgaagctaccttgttctttggaaatgttcctcagaatcattaacattagtcatgtgggagayaggagaagaagctctgcagaaaagggaccgagaggacaaggatatagcttgggctggggacaatgtcagagtccaaactctggctatcttggaatagtctgtgtgaacggtgccctcccaagttgtgcagtgcacaacctgtgcagctatatatggcaaccctgcccatccccagtggtttctcactgggaaagcagagtatttcctcagggatgtcattatgtgacaatagtggaaaaagcccaggaaaatctaagaccttctaagactcatgggggcccagagctgggaggaaccaagctgttgctcagttcagaaaacttctctagaaatcccagcctctcctcacacccctccagtgacaggcagacttgcaccaccacaagcaacagccacttttgtggttgggcagttttgtaattaaatatactamtgtgtgtatgtcataaattacattttccaattatgccaaaagagccaaaaatggttttttaatggttagcatataatcgtttttatcaaattgcttgaatctttcatgttaataagagagattcattactatgccacaaaaagcaaatactggcattaattatagaaacaaattaggggggtggagcgcaatggctcatgactgtaatcccagcgctttgggaggctgaggcgggtggatcacaaggtcagaagtttgagaccagcctgaccaacatagtgaaaccccatctctactaaaaatacaaaaattagccaggcatgttggcgtgcacctgtagtcccagctactcaggaggctgaggcaggagaatcgcttgaacccagcaggtggaggttgcagtgagctgagatcgtgccactatactccagcttgggcgacagagtgagacttcatctcaaaaaaaaaaaaaaaaaaaaagtggctcatgcctgtaatcccagcactttgggaggccaaggcgggtggatcacaaggtcaggagatcgagaccatcctggctaacatggtgaaaccccgtctctactaaaaatacaaaaaaaaattagccaggcatggtggcgggtgcctgtagtcccagctactcgggaggctgaggcaggagaatggcgtgaacccaggaggaggagcttgcagtgagccgagatggcrccaccgcactccagcctgggcgacacagcaagactctgaaaaaaaaaaaaaggaaagaaagaaggaaaggaaaggaargaaaggaaaggaaaggaaggaaagaaagaaagaaaggaaagagagagagagaragaaagaaagaaagaaagaaagaaagaaagaaagaaagaaagaaagaaagaaagaaagaaagagaaagaaagaaagaaaaagaaaagaaaggagttagggagaaaaaaaccctttctttctttcttttggagatttccggaaaatgtacccttacggatgagagcctgtgtcttcatgggttagagaataaccacgctttgtgcataaaaagttattaagcacaattcctgaattatacataattactagctgtcagtcagttgtgcatttctgtgtatgctggtcttcacttaataagactttatttcacagatcacttggtgtccctacttcactgaaactaggtgattatcttttgaagtctcatttcacataacctaggaggtatatagatttctttaaaaatgtcattgccattattttaaaccttacccatggtatatataaacttacagaaagacagaataggttcattattttaaaccttgcccatggtgtatattagctcacagaaagacatagaataggttcctgccttaagaaaacctgacccacaaaaaagcctgggtttacacaaaagaggaattaagggcggggagcccaccttacaacagaatgaataatagaattttatccaagagcaggcatcctgaggacatttaagacccrgatgcatttttccttgttcaagagcacacatccaaaaattgcagtctttctgcgagtcatgatcactctgcacataaagcgtttaggttcagagctcggggaggccattaccatggctgctctctgtctgccctgtgagggtccttggggtggctgcactctggggatggtgctggggctgactgactcacgcggtcgtgtaacacatcagaccttccaaagtcgaacccttgttttgtttcaaggctcaattatgacaggacttggtctcagagcagatcccctccctaggctggagaaggccactttaaaacagatggcctgccccacttcatcatttttatggctctgatctgtgttctccactggcctctggtaaatcaagaatacaagtggacatgaagatctgctttaaaaaataaagaacagaccgggtgcggtggctcatgcctgtaatctcagcatttggaggccgaggtggatggatctcctgaggtcaggagtttgagaccagcctggccaacatggcaaaaccccatctctgctaaaaatataaaaattagctgggcatggtaggcacgtgcctataattccagctactccggaggctgaggcaygagaattgcttgaacccggaaggtggaggctgcagtgagctgagatcatgccacttcactccagcctgggaagcagagcgagactctgtctctaaataaataagtaaatgaattaaattaaataaaaataaagaaccaattaagtcctgtctacaggaaaaggccttacttgctggagaagtagcttgctgtgctggagtagactagtaagttggaacggtgatacagtaccaccttacagagctgctctagggcaccatggggactgtctgagaagcccctggcacactgtaacaggtggcatctggtgtggtgatgatgatgagaatgatgatgaatgtgaaacactctgctctcatttctagaccaagatttacaataaaattatgcacctgtccacctccracctgtccatgggagaaatgactgctggacagatcygtaatctggttgccatcgacaccaatcagctcatgtggtttttcttcttgtgcccaaacctctgggctatgccagtacaggtactagatgggctgaggggaagggagrggggcagcmggacacacaaccagaatctgctggtccatggccagtaactaggagcacaccgtcttccactccatgcttgcctgtacctttcacacacttggctataccacaggctgtacctctgggtccctcctgtcccatactctgcaagcactgaccatctctcttaatgaccagagaaggcagtatcattaagactttaaaaatggagccaactttataaactatagaaaaatcaagccaggttcaggggctcacacctgtaatcccagcactttgggaggctgaggcaggaagattacatgagcacaggagttcaagactggcctgggcaacacagtgagaccccttctatgcagaaaaaaaaaagaagaaagaaaagaaaaatcgtacatggaatgcccacagatcttaaaagctatgttgtagcaaaatatttaattacatcaaaaagtgttagtgatgtatttttaagcaaaaagagtaagttacaaatagtatatgttgtatgcttactactaaactggaatatatgttatgtatacatttgtacagattcacacatgaaraagaattggaaaatcacatagtgggattataagtgatttttattttctttatgtgtttctaaattctctaataagcgtgtataagatttggaaatcarcaacatgatacttttagcctaggcaacaaagtgagaccctgtctgtacaaaaaattagctggaagtggtggctcacaactatagccccagctactcagaggctgaggtgggaagattacctaaagtccaggaggcagaggttgcagtgagctacaatcacaccactgcactccagcctgggcgatagagtgacaccttgtctcaaaaacaaacaaaacctggtgttttttagccagatgtggtggtgcgcccctttagtcccrgctacctgggagtctgagatggaaggattgcttgaccccaggagttcaaggctgcagtgagcaatgatcacgcccctgcacttcagcctggacaacagagagactcctgtctcttaaaaaataaaaataaaaacgttaaaacatggtatttttttaaagcaagacaacctttggtgctggctcaggaagaggtacattaccccccaataatcagaggagaatcgtcagcatgattgatctgacctcgggcttcatgtgtcccatctcccacccggagctcttccaccacagagtctgatcctgtcctatgcctgggactaaatcttcaccctggtgttcaggccagaaaccgaaatcccagacccattcccagagggcgggaaggttccaccgggagagcttgatgtagcagaaagtgacttgggtgagacaggctgattcaaatacttaacctctctgagccttggtttctttatctatgaaatggggaggmtgcccaccctctggagttgctatggcaattcagttagataatgtaagtaacacagcaggcagagtggcccccagagtcttcacttcgtaaatatcagatccctctaccttgcacatgtktggtatgagtgaggtgttaccaatccagaatccattgcttcttgggataaagattccataaaccttcatctccagtgatttgtattggtcctccttacttgtaaagcttagagtttaaaaatattaaaagaaaaaaaggggagaggctcccacagggacacagctagacaagatgrgatgcagggaatctgatgttcttttttatgggaacagtcatatatgccatcccccattaccacctacccatgcccagactgcccccgctccattctgccaagacagatcaatgactataaaagctacaaaagggcctggagatctcatctagtttagttaccaaccaaccttttatgcacaagactttctaagctgggtrtggtggctcatgcctgtagtctcagccactcaaaaggctgaggtaggaggatggcttgagcccaagagttcgagtccagcctgggcaacatagasagacctcatctctaacacaattttttttttgaaacatgaaaaatgaagatttctgaccatgcttctctcattagttaacactttgggctgtgagggtctgatgcagagagacacagcctgggaggatcctaacatgtacacagcattcaaaaggctacaagacactttctgttgtgtccccttgaacaagcagtttgtaagattttgttggccaggcatggtggctcgctcctgtaatcccagcactttgggaggctgaggctgatggttcacctgaggtcaggagttcgagaccagcctgaccaatatggtgaaaccccgtctctactaaaaatacaaaaattagccgggcatgatggcgtgtgcctgtagtctcagctactccggaggctgagacaggagaattgcttgagcccaggaggcggagactgtggtgagctgagatcgtgtcactgcgttccagcctgggtaacagagcgagactcggtytaaaaaaaaaaaaaaaaaagaaatcaggttttgtctactaaacctgctgcacggttaccgttactagtactcacagggtttgttgcacatgcatcgttgctaatagtgctaactaatattaacagcccttgccctatgcctggccctgtcccagcccccctcccttgtataatttaacccttgcactgggggtagrgattttcatatctactgatttcttacctttgctcatttatcatggagtgtcctttggttttctgtgtttgtatatacctttaccacttatagatttgaccagcactcaagaaccagtgttactcctgggagttratacaatcccagccccatggcaaagaaactcatgtggttaggattctgtgtgcagcctggttagccacagggcacgtaaggctttttataatattgacatgagtgcagaagccccattcccgtgtaagccctgagggctcttgtttcatmatctttttttggtcacatgcacacagctttattgagatataacccactcatttaaagcatacaamtcagtgggttttagtgtcctatattcacagagctgtgcagccatcatcacaaatgtggaagttttcatttccccaaaaagaaacccgtacccattggcagtcactcctcatcttcgcccccagcccttggccaccgtttatctacacatacttttgaaaggctagtgaaactttctcagaaaaataaatgcttgctcaaacatttgggctataatttcaggggcttcatgggtgcccccctgacatttatcaagaacaccaggttaaggaatttagctataatggaggcctctgtgtttcccagtctcctgggtatcagaggcccagagagggcaggtgccttaccctgggccacgcagtgaaccagtggcagcaccatactcacacatctcctttctgcggttccccagtgacagagttctcaggaagctttttcatttattttctgagaggagggtaggccaycttgtattgatctccaactatatgccagccacaattctaggtgcttatcataaaggttcatttaatcttcacaatagtcctgcagagtggacagagtccttcagagtgggcattataatcaccattttaaagatggagaagctgaaaaccagagaggttaagtaactcacccaagactgcacagcaaaaggctggggctttgaaactcagggccacagactccaaagactatgtcctccccactatgctagattkttttcctaacctgtgaataggagacaaaatagtccttttatttctcacagttgctttgcacactcagaatccatgatttcttctgcatgagggccattcagacctgtgcagaagagagtaatggaccaaggagtcttgggagcrcctaggaggaggggatgggggagcatgaggaggagccagggaacagcagcagctgcagcaccagctcccaccccagcckctgccagtctcttggaggtggtgtgggtgcagacaccggctcacaaggtgccctgttagtgagcttggggtgccatgggagccttcttgttgtcaggcccaacccaagctggctgaagaacaccctgatggcctccatttgagcacaactaatraaggactggatgccagagataagtccaggagggtgatgctgcagggcaggccagggaagagggtacttcatctctatcatggtcctctgcccatccatgccagcatctaacacctgttaaacactgggaggcaggtggtgaaggggccacttcccagcctctaagatacctcctaagccaggaggcattctgtgattaaattacagggcctcccacttactcctttatccttgaggcggtgctggaagcttaatgccaatctggtgtagggctctgggactacaggaccaaggcaagcagtcctttctctctctctctctctttttagctaaggaagccagcacatctgttctttgagaaaaagccctgtatttagaggtgtctgcctttgaaggcaacctgagaaactgtcatcttggcgctttggggactggccatttacacttctcataaatattcagaagtaggcagtcatttacataaagctaaatgcagaaggaattctcttttcagggaatacctggcagattcattaaaaaaattaaagaaaccaagagcataagaatgaaaagcgaattctcggaccccaggctggttttttctggcatgggtgcagtaactttgcctctttgctcagttatcacttttttccaatgacagtaaccataagccctgagagccagcaaatagaacaaaaggtgctgtcacaaacattgtgcaatctcatctctgagatttccatctggaaaatagactggagagagttaaggcttcaaccagccttgcagataaatgcagttagttaccagcccagcaaccctctgcttgcatgagagcccattatgctaacctccttttgaaattgctttgtttctcctccttccctgcactccactccccaagataatttggaaacctgggcaccaaggcttgtcccactctaggggactggggaaacagggattttgccagcacctcctggcagggcaaccatcaggtcaaagggacctgacccatgaccccttcctcagatcattgtgggtgtgattctcctctactacatactcggagtcagtgccttaattggagcagctgtcatcattctactggctcctgtccagtacttcgtggccaccaagctgtctcaggcccagcggagcacactggtgagtgcccaaaggtgtgtgtgttttgtccctcttcccctccttccctcgacagcagcaggtctcctcccacacacccacactgtcattgactttgactttgactttgagtaggccacttcacctgtccaggcctcagcttctttgtctgggaaatggagtcaatgggggaggaggctgcctcccggtgrggacaggaggcgggcatggcagtgacagtattgacactcaggccttcctctcgggtgggagacggagcagaagcctctcccctctgactcggggacccctgcaggagtattccaatgagcggctgaagcagaccaacgagatgctccgcggcatcaagcygctgaagctgtacgcctgggagaacatcttccgcacgcgggtggagacracccgcaggaaggagatgaccagcctcagggcctttgccatctatacctccatctccagtgagttcaccccacacagccagccctgggtgctgctgcgtacatgcaaggagagggtgtcagagctcgggtaagagggggtgcagggacagaagcaggaggccttgagattatccgactcagtaggggagcctcaaactggctctgatagctaagctcccagaaatcaaagtactcttcattcatttatccaacaaacatgcatggaaagcctgctatgtgctggacactgtgctggccctcaggatacagtgatgaggaagagagatgaagtttcattcctcatggaactgatatgttattgacagacagcagcaagtaagtaaatgaccacagttttgaactctcctaagaatgaagactttttagtaagtcagactgagctgtcattgccctggggaagctacaagaaagcttccatccacttggggctatgcaaaagaaaaagactagttatccttaaatatcagaagcccaggctgaaggtactcacaggtgtagggactgaatttatattaaccaagtagtttgggaaccccaagccaaggaagaagaaaaagaccaaaactggtaaaagtcctagagtcccatatacttgaaaccattttactgagaatgtaaaacttttttttctttttttgagatggagtctcgctctgtcacccaggctggagtgcagtggcaaaatctcggctcactgcaacctccacatcccaggttcaagtgattctcctgcctcagcctcccatgtagctgggactacaggcacacaccaccacacccgactaatttttgtatttttagtagagacagagtttcaccatattggccaggctagtcttgaactcctgacctcgtgatccacccgcctcagcctcccaaagtgctggaattacatgcatgagccactgtgcccagcccaaaagattttttagaaattgaaattttagttatggaaattaattcagtgaacaatggtcccctggtcagagtgagggcttacggaggtcaggtgatccatggagtcctggcccaagtttatctcacagttggtctcrtggctccgtggacccrtcccatggtggttacttcccaagtgcataattgggatgtagatatttagcaaccagctgacttcacactagttccctgacctgtccagtctaagagtcattatggccaagtggaagcccctggaaagaagaaaacaaaaaagaaaccaaaacttactcagtgcacaggttacatgaatgagtatagctgaagagagaatttttgaattagaagacagatgagtggggattacacagaacgtggcaaggagagtaagttggtagaaccattttacagatgggaaattaaggccagaggggagtgtgttcctgagatccctcctgaggttagtagcntggctcggactagatcctccaaagtctcttaactcctggtctcaggctattttccacaaagagctgggggcctctgtggggtgaagaagacttaggacaccatggggcaccattatgaggccatttcctcytaggagaaaaaaaatctctgggctctgaaaggagtagaattagggtaggaaattaagagaggctaccgaccacctcctccaactaaaattggttcttttggtgccaggaagagacacacctggtgggggagggaaggtggtaatggagggggtgctggtagtgtctcccagatagacccatccaacaagtctcatggagaatgagacggtcactcaggtcatctgcgtattcttggcattcttgctgcctagagagagagtctgatggagctaggtggccaccaagctgtcccactccccaagacagtttggaaacatgggcaccaaggcatgtccctgtctaggggactggggaaatatcccatagcagtgttctcacagtatggggctggccatgaataccccaggagtccaacctccctktgtccagctagaccatggtgtcctatgcctcaggcagggaatgtggtccagtcatcagtggctgggccrtctgccatacatggygcaagccatggcgttttatgcagaaagtcctgctagcatttgattttctcagaatggagctgtgagcatggcaggcaaccactgtttcctggattcttcaccaagacaccccaagttcctggtctctccccgttatcctcatccctgaccctgtggttctcagagcctccaaacacactcaggctaagcactccatagacaggggaaatttggaaggaacatctagggagctcagaaaagccaatgtccctagccccaggcccacttcaaccttctctctgtcagtcctgcctgcccctggaggctggttacatgaagagtaaccccctgcttgtgtatagccccccagttttgtacaggtttagagacagttcccagcagtaggaacagctgccgaggtgggagagggcttctcccgatagccgggggacttcctctcccaggaacaacagggtggggtagagcaggcttgtsgttgctgagatagagagagggaagggaaacaacaaggaaagtgggggcactgggtccccaaggttcctggcacagcaagcagtgaagttggggcagcctcaggtcatgtagtgggggcaggtgacatctgctttgactgctcctaagagatatgtactcatctcctggattccaaactgcagcctgggacatgttttcttatrtaaacagcatcaaaagatgtgtgagttcccaggctagcccactgaaccctacctagtgggtgctcattgtcccccagagcccccagaagacaagccgtggctttgtgatgggcctggggccaggaggacctagggatatgttgtgaagagctgagaagactctggaaaaaaggggctctggagccaagcaggagcccgcccaggactcctcacstgtccaagtcacctagggagagaaacagagcagcccaggttggtccctggaagagagcagcggaggaggggaaaggggagagcccctggggagagctttgaaagtcaagtgctgtttgctcagtgtgtttgcctttccgaggatgtgtttttttttccctccgttagtcagcagtgggagggggagagagacgggtggtagggtgcagggtacctcctggctgcaggcatatgctttgagtgcgtgttcatttacctcctctggacttcctgccttctgttaccagggatcaagacacaggtcattaggcgtgaggtaatggggcatctcttgttctgrcccctggcgccagtcttggagtcctgacgctgcagaggagccccagagtcacatttcctgttggggcccatcctgctcatatgcggcaccrtcagacttctgggcaggcaagattacctgtgactctgtctgatggtctcgccatcaatatcactgagagtagctgtgtatggagtcccgaactggtacaggataaaacagggggctgaaaagggaatgaatgggcacagtttctctggcatcaaaagtcacatccagaattgatatttcctgttgartaaaaatagaaatataagttgctcagtggatgttgagtgagccctattcatgtgccccactctgtgccaagcaccaggaaggagggaagggaaaaatgataagatgttctccccgttctccaggagtttatgctccactaagaagtcagagctaacatgcacagaacagtgtggcagcgagagcagaaccgtgtggccagctccatgcttgccgcctagcaagcgtgattgcacttcatcctcataacaacttggtgaggtgtgttgctctgttgtcccattttacagcagagaggactgactctcagtgaattgaaatgtctcagtgaggtcttccacagcaaaaggcgaagcacagagaaggaagtccatgtgggctgggagttcacccagagattcatgtaggggcratgtgggctgtaccttgcaagayggtgggatttcaatgaggagaagacaaagtgggaggaagctggagacaaggactgtggtctcttcctttagaagtcagttcaatctttttttccttgyggaagcagcataactctaggtggttcctctgtatctgaggacaagctttgtagaggtgacaaaggggtcctaggtcctatcaggcaagcactcgatwtgctgccagttcattctgtccattgtgagatacccattccagagcgcttcctctgtgccaggctctacggaggttctggatgttaaagaggaagcaggcatggccctggccctcccagtcttgtgggagattgatcatgcccatgaatagtgrccatgtggtcagagccacagggtcaattccaaatgcccctgtttctcttttgtgttactcacctgactctgggtctttcgtttcttccattcattttttttaaacaaatatttcctgcccaccttctgtgtgccaggcctggggatgcagtgggagaagcctctgtcctcctcagtggaggcgctaactcagaacaggcagtggagaaaaacaacatgacctggagacctggtgccccttccttccccagcatctttgaaattcttttggttgttgttgttttgagayggagtctcactctgttgtcaggctggagtgcagtggcgcgatctcaactcactgcaacctctgcctcccaggttcaagtaattctccctgcctcagcctcccaagtagctgggattacaggtgctctctaccatgcccagtaatattttttgtatttttagtagagacagggtttcgccatgttggccagcctggtctcaaactcctgacctcaggtgatccacctgccttggcctcccaaaatgctgggattacaagcatgagccactgtgcctggcctgaaattcttcaatwtctacctgcccttctgccagttggtgcagccacagtgggctgcttatgcatatcctggcctggcttggtggggagcatggctgagggagagccggggcacccatcaattaaggaggtaaagatcagtctgactgagatgcctcctgccacacttcctcakctgccagcaactgacaccattaacctgatttccttccccctctgttgactgcactgactattggactgaawgggaaacagcyccgtgcacctcaaaatgcacttcccctcctgcagatgcatcttgcaattaggcccaaactgtgagcctgcatgctcctcccctggccctgcacaggcaacaaagctgaagttaatcagaggtacaaatggctggctatgcctctctgacacgtaacttctggaacatgtatcaatgctttggaaatgaaaagctcctggtattgcaatgccaggctggtgcccataagggccagaaarcattccttgggcaaagccagggggagtgggtgatctgatcccagctcaggtttgttgatttgttgttttgtttgtttcgttttgtatggggcaagggttgagggtatgaaaaacttacactatcatttactaccgtagyccccagaacccagcacaccagcacaaggcctggaacagggataccttttttgaatgaataagtctttttttttttttttttttttttttttgagacagagtttcactcttgttgcccaggctggagtgcagtggcgcgatctcggctcactgcaacctccgcctcctgggttcaagcgattctcctgcctcagcctctcgagtagctaggattacaggtatgcgccaccacgcctggctaatattttggtatttttagtagagatggggtttcaccatgttggccaggctggtctcaaactcctgacctcaggtgatccacccaccttggcctcccagagtgctgggattacaggcgtgagccactgtgcccagccttgaatggataagtcttaagggatatttttggaaaggatattctaaaaaataccyatgtctctacactattgcagaagggctttcagttttgatggcagcctttcaggccagcctacacgcaactaaacttttccataacagcatcacacttacacaagaagaaggttttataatccacttgccattatttaacatagttcttcctccttaactttcragatctgagcactataatgttcttctttttgtttttgkttttttctaaatcaaattaaggtgagtcacctcaccttgggcctgagttggacagaaatctattcttggctatattccccacccctccaccaccttggaaccttatagaactttatgtggttcaggaaaatgagggcgaggcctcagatcttcaacccatgacagctgtatgcccagctccctgccttcctgtcttacccccagctagggcacaggactgactattgtgcccagagaggtgccagagcctgtaacaaccccagacttcccaggtccagccacatccaccccagagccccaaaagatgatcttcagagagacctttaaaacacaagtagctggtcacttccatccagaccagaacccaagatggctgtgctcttgctgagacatgttggttgtcattgcctccgagcccactttagccctcagctctgtaccagaaatgctgttcctttgggaatcacagccaaagaagagatggagcagttctggaataagaacacaagttcaaactgtcccatatctccccacatcactatctacagttggtctcttcccatggcgatgtccatctgccaccgtggcactggtattgctttgartgcaggggtctctctttttggcatgttggccctgttactccctgggaactttgagtcttatttggaatgcgtgaagtccctgtgtccggggccagcactgatccacacagctaagtttgcactcatcttccctctcatgtatcatatctggaatggggtctgacacttgatgtgggacctaggaaaaggcctgaagattccccagctataccaatctggagtggttgtcccggttcttactgtactgtcctctgtagggctggcagccatgtgaagaacagaggttcccagcatcatcttcctacacattattacattcacccatctttctgtttctcacttttatctccagcctgggaaaagttctccttatttgtttaaatccttttgtgcttttagatccccttggagcagtagagtaccttgtagaccataagagtggaaaagggtctagttttctccttgtttctaaagatggggtggctgaaaaaactccccttttttgcctacagcttgcctctctgggcctagaagtggttattctgtctccatattggcctttgatttgtgctgagggtcagcttttggctccttcttcctgagacagtggaaacaatgccagctgtgtggcttctgccctgggggctgggggtgaggctttgggtgccactgcctgtgggttgctggcttaaaggacaattctgttcattggtgagagcccaggccattaacacctacgcagtgttattgaaagaagagaggcgggggtggaggggaattagtctatcccagctagagggagataaagagggctagttagttcttggagcagctgctttgaggagaaaatgtatagcttttgacacaacaggaagatccagaaaattatcattgaacatattaaaggttatttctttttcttgcaaaacacacacacacacacacacacacacacacrcrsgcgaacacacgcagctgatgattctactctcccagccccagccctgaaggggacccagaactccctgcacaaaggctgtccttcaaggggagggtgaaagaagtggaaaatcacattttcattctttagcgtctccatacaacagccagaactgggcagaagctaattatatcagaagcatactccatgttgctgcatcagctttgggatgttcatttttaaatttatttatagcttgtctcattcctcaaaggagttcagggagctacaaaaataaagacaataaaattgaaaaaaattaaattaaaaaaaccatgaccagggaaaatgtgcagtagaatgaagtgtcaattatcacgttttctgactgcaaaatctcccccacggctgatgcaccatcatttactacaacagcccctcttgttggacatttccagtttatttcgtttgggatggtttgttgctgttgctgtggttgtggttttgttttattgaattttgtgttagctgcagctaataccatcttgctgatggctttgcgctgctcttgaatgattactcaggataaatttcctggagacggattataggatcagaaggtctgaacttctgtgtggctctagctacaaagcaccagattgctttccaagagcgttgtagcaatttataatccaacactcagcctattttttggctgggagtcaagccccagaatgtgaaggaggggtcttggcctggagcaggggctgagggatgggtgcacaggacccctccttattggttatttatggggatgggccaggaggagcagaatagaggcccctgccctcccagttgctccttggagtgactgaccccataggggaggggcgaggctacctcacatttagaactatgtagttggtgatggtcaaggtcctaggtctgatgggcatcctcctccctctcctcctcagccagtaatggctgcactatgtcgtatgtcctagatctgggtcccttttgctgtgggaacaccaataatacttacgctgtttcctgccggaaacggtgcaggagggctgtggcatggtagtgggccctggaaaccatctagccttcatgaggaagggcagttaaagcacaggcatgtatgatgttggtattgattaaaagcctcaygggcagagaaattcgccatctgccagggccccagccatacgagggctccagccatacatcctccaggagactgggacctctccaattgcaggagccttgccttccccatcagattaggaattccccgaggatggggacaatgtccttcccacctgcttgagaactcctaaggggcatgtactctgtctccccattgtatctggaacttcctgggagcatagctcctgtctccgtcctcagactgggaatcccctaagggcagaggccatgtccttccacccacttgggattccctgaagttggggaccacatctctgatgtacaatgctttgtatgtactgactgctgcaggattcttggagtaaatgggcagtcaacttcttggactggtattgaccatctggacttcatcagagtgtccaagactttgccattcattagacaggggccatgtgcacaggcagagccctggcctctggcttctggctcctgactcctggtccctctgctttaatttggctaatggcagaaccagactcctttctgggctgccctggaaggggatccttgaatgaaagaggatagatgggaaggtggcagctgacatggttacctcttatgccatgggggggctgctctctctggaaatttaggcctggggtcagggcactgttgagcattttacaccctaggccagaggaggggtgacctgtggagcagggctaagctagtagcccatgaggtatratgtgkrggcagcacctggggctcacagagcctgttacccatgttatctcctctgaccttggaaagagctggggtgtatgaacaagtatttataagtttacaaaaatcatatgaggaaactgaggcacggggaaggtaaatgacatgccctaggttacacagcttataagtagcagggattctgcccttctgtcacaccaagtcccactgtcttttcttcctggagtccctgtgactgatctaaaggccacatgtttaacagaataaggaggaggcctctgttgcagcaaaccagctaccccacccgcacacagactctaagggacatcctgctttaagctgtccttagttactaatacctcagtgagaatgagtttgaaattttctcaagagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcatagtaagtggatcctttctccatctcttgggggtagggtggagggggagggcgtctgcagtgacaggctgcccagatttggcctttctgcacaggggcctcagaagacaggctccacagccagactgaaaataggatcgaaagtttatagagggtgtggcccctccccaactccagccgaacaggggcctctgcctccaggcctggaagaccggaggcttagtatttagagaaattaaactttcttttaaaaaatagctatccaaatttttaatttttaaagtgaaacatgtgtattgtagaagtgatgrgaaatccagaacagaaagctcaaagagaattaaaatcacccataatcccactggtaacatttttaatgtgtttctttccagtctttttttaaggcytatgatatgtcattttctacaaaaataggaatgtgctatgcatgcagttttgcaacctgctcttttaaatttaggaatatgccacacacaattctccatgccactgaatattatgatggtggctttctaaagcaattttgataaaagctgtgtgtgagctgagccatgggggtcaagcagcatgctcctacagaaaggcctgggcccytacgagcctgcagccccctcacccagcctcccatccccatcttctgtgatggctgcagttccttaaaaagatctgcttatttcccccggggccagtgtccctgagctgtgtagagttcacagcctgtcggatacacttgggaattcacttccaatgtgatgtattgagctggttcctggcctggctcctgggggaactgtgggtaacagaggccactgagccagccaggtggctggggcaaagcactgtgcagtttcgtaatcactctgtttacgttatcccgatgaggactggggagatgagcaccccgcctgctgtctgcagagggggccgtgctgacctaacccgagatctcctccctgcttattcccagccaagactgggcaggacagggagtcttggccaggacagggagggagcagcccctgctctccagcttgaagtcctgaacttgttggggacgtttccatgagatgactgtggggatgatgaaggtgtctccaactaaaagatcctcttaggagcctgctccctgmcagccctctcatttcccttccartgctgagcgtttccagtgtgggagggacccacaccctgggccaccctggcctcacttgtgcctctgtccacagactttcrtgggccaygtcagcttcttcaaagaggccgacttctcgccctccgtggcctttgcctccctctccctcttccatatcttggtcacaccgctgttsctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaacttaaaaaaaaaaaaaaaccagtgttgagccaaatgtggaatcctcctaaattctacccactggtcctaacttcaccctccagagccaccaagaatgaggccatcccktccccacgtggctgccccatggatatcagaaggcatccactgtgtctatctttcccaggccaagtatcccctaccctttccacagcccctgagccctcacagcctcagccagtgaaacagcttcccccaagcgctgggtcctgctctgattggcccacagctcttggaggctcccacttccaggctctagagcctcatggggactctgccactgtcccagaggcattgccctcttgggaatgaaagcctgaaggtagaaggctgaggctttggctgggaaatgccctgtctggagtgagaagatgtccttgggcctctgaagtagctctgcctccttgaaagcaagagcctgtcatgcctctatggagggctggcttgtccttacccatggccagagaaccagtcagtaacaaatgtcctctgtgtcttcagccttgaggaaggtgacacccctgtctcatgggaccctggcaggtactgggaagctggaaggaaggagtagctgttggaatgaagtagctgatagagagggtagcttgcagggggagactctagcatgggttcaaagatggaatggkgcataactcagcaaaattatgctctaaggagtatctgaccaggcagtagctggttaaacagggattagctcccatttccacagtcggctgtgctgactcagtttcttgaccagggtgttgtggggtctgaagatcacccctcctcccaccacccactctccagccctatgattctgtgtagaaaccacagatttaagaacgctgcacctgcctgaaaactgttgcactgatcccaaagcgttcatattttcaaacactctggatcccactgtttccaggaatggaacaccagagtagcagaggccttttcagtgaggcagctcaggctctggctgaaggtgggckcaggacactacctgaagcttcaccccaagagatgagggccagctccactcttcccagtcaccgcctgtgggggagggaggctggacagggsatgaaggcagagcctggtggtctgcccctcccatctaggggtggcgcacagaaagggagactccaggccacagctcacttacaccccagaataaccttgccttgagggtgggatggcttgtctgccccaggcctgttggacatttagcaaaagagaagaaaggggaatacaaacaatcctgagcttcccagaaagctttcacacctccaggatgggagagaatgaactagaagagtgaagcttccagtgcttcctcaggtccacagggaaatctggacaggggagagggtaggaatagccgcctcccccgtgagtaatgacacctcctccagcaggctgttatggggatccgattacataatgctacaaaacagttaacacagtgtctggcatttagtgtatgctcacaaaatactagctattgattctttaccaatcctagtcctaactaaccttaaccctgaccaatccaacaccaaccatccttcagtctaataacccagactaactaacttcaacattaaccctaaaactaaccaatctcacctccaatccagaccccagcctattccagctgactggtcaaccctagcaaaccctggtaacaccaattacctgcccccatgcccactggtctgcccccttcagtgtgggctttgtgggactatacttcaggcctgagatcctgctcagagctctctatcaggctgcgccctctcccctcccctctgcccctggcaggggtgaggggtgtctctgtgcttcccgagcagcgtgcaaaagctaagcgagttcctgtccagtgcagagatcygtgaggagcagtgtgccccccatgagcccacacctcagggcccagccagcaagtaccaggcggtggtgagtgcccggcctccccttgctactcccagcatggtcctctaaggcccaaaacttgggcctgctgtgtcggacttctgccttttttcccaggaagaggggctcccttccctacacagctcccagcccagtgggtcctcacctccaaaccacccccagcccctcagggttgtgaaccgcaarcgtccagcccgggaggattgtcggggcctcaccggcccactgcagagcctggtccccagtgcagatggcgatgctgacaactgctgtgtccaggtgagtcctgctgccccatgcctggccacccagcaccaactcccagagggagctcagcacctggaaagccagaaagctgcatgcttagtcctctgcagaggtcaccctgcctgcctgtacggkccataggagtccagaaaccagggaccaccaagtggggggacccccagccttaggcaagggtcagcatgagaaggccagtctcccactcccctgctctggaagtgatccaggggctggaatcagtgtcttttggctttcatggaggaggggaagccagagactattcactgggaactggctgcctttctgttctctcctgggcggtgggacacgcctaatgaagatcatgggaggctacttcacgtggaccccagatggaatccccacactgtccaacatcaccattcgtatcccccgaggtatggcccagtccacccctccagcatgcccctccccatgtcccactgaataacatagagataaaaagacaaagctgcatttattgagcacctactctctgctcattcttggtgtatgccctgggtatattatagaaggggaaggctacattctagaggcttccgtgtgctgggtgggagtgaagcactaaggacagggtaaaattgccagccttaatgtcaaaccatccattgcagacagtataggtaatgcacaaaaagatcagaagtgggtagccaaggaacgcaagtggaagtgatggggtttctgagaatggacaaaggccctgaggccatgaggcaggaggattttctggcagaggcagccatgagcaaagtatggaggtgggttggaggtgggacccaggatggygtttcttgggaccacaaggagcctgggctcatactaggagcatgggaaaggagaagcgagtgcttaggaagggtggcggggcaggaaatcagagagggggaaggacctggggagccagaggaggatgttgatttccagaaggaaaggattaaagagggagaggacttgctggggattctaggtaggaagaaagaaaacaggggccccagggttgggtgcatctgtctgtctgtctttctgggtaatggttgttcagactcccccggccccactcacrtctgccaccctccctccctgyaggccagctgactatgatcgtggggcaggtgggctgcggcaagtcctcgctccttctagccgcactgggggagatgcagaaggtctcaggggctgtcttctggagcaggtaatacatgtatcctcagggcccagtggaggggaaatctccttttaaccatcctcctcagttgaggatgcacacacatttattggagggcccactctgtgttcagtgaggactcaataaatgctgctaatggatattctcatcatcatcactagtacgtattcacctcttactatgcgcaggttctttgctaagtcctttgcatgcattatttcatttaatttttatgataactaacaaggtccatactgttctcaattctcatttatagaggaaggttaaactatttgtcctaattcacacagctaataagtggcagagctggaattgaaactcagttctgtcagactctgaatcccatggttactcagatgcacggcagtaatttcccagtgtgggaaattgcaacaccaacattggtttccagcttggtcctgagctgcactgacctacacaccataagtgggtgttctgaagatccagatgtaaccaataaatgttggtttctgggcaaagatcactgtcttaattaaagagccagaaccccaggctcagtcaatcacgaatctgttatttatacccacctacttccaagaagcacttgaaactagttgatgaaagattcatgtaaaaatcaaaaccacaatgagataccatctcacacccgttagaatggtgatcgttaaaaagtcaggaaacaacaaatgctggagaggatgtggagaaataggaacgcttttacactgttggtgggagtgtaaattagttcaaccattgtggaagacagtgcggtgattcctcaaggatctagaaccagaaataccatttgacccagcaattccattactgggtatatacccaaaggattataaatcattctactataaagacacatgcagacgtatgtttattgcagcactattcacaatagcaaagacttggaaacaacccaaatgcccatcaatgatagactggataaagaaaatgtggcacatatacaccatggaatactatgcagacataaaaaaggttgagttcgtgtcctttgcagggacatggatgaagctggaaactatcattctcagcaaactcacacaggaacagaaaagcaaataccrcatgttctcactcataagtgggagttgaacaatgagarcacatggacacagggaggggaacatcacacactggggcctgtctgggggtggggggcaaggggagggatagcattaggagaaatacttaatgtagatgaagggttgatgggtgcagcaaaccaccatggcatgtgtatacctatgtaacaaacctgcacgttctgcacgtatatcccagaacttgaagtataataaaaaaagatgcatgtaaaataaaaccctttaaaaaggtaagaaaataggaactgagaaatgaagagggtaaaaagatgttcagcaacctgggcagaggacaactacagccatcaacataaaacctggctctgtgccckctggtagccaagggaaaaagggatctctgggctttggagtattcatttaggaataaaagttgcagccaatcagcagaagggcaagctttccctaccaatcatttctaggggaaaattattgaaggtgtcaggtttttcataagcwtgagtacagaactgagcagggagaaagactttgggcccaatgtctgaatatcaacatgcacccccgtttcctgcatttccaagatgtccctgaatggtgtatccaaaagatggcaaatttccctcctcagtggggtcgtgggctagcagatgagccccttgggtttcccatcacctcccatcagggactgtgatgtctttgggggcagaggggtctttgcctccattcgccattttatttgggagatttttcaacatagcctgactgggaaggcccaggtattcggtttgagatcatattgccttattccgactgcctctccagcctttggagggaggagcccttttctgctgtccaactgcatgcctgcagcaagaagacaagagtccccagtgcactgtgagctgaagaaagtaaccaatatttattgggtacctcctatgggccatgccctttgctaagtgcattgtcaacatgatctcatcaagcctcctactaagtttaggaggggagtgttgttaccccatttcacagaagcagaaactcaggctcagagaagttgggtgacttactagtcagtgtgtggagcagagactctgcccatgttctttccctcaaacctggtcactgctggggcccccagggcctagtcctaagggttattgtccaagccccatgtagtggtcaggctggatctgggctctcctccaaggcagggcttttccagaaggattgcagggctcagacactggagctgcccctgccttgacctgctcagcatggatgtcaaaacccactctgaacctggtccctttgccctgytttcttctcctcccccaccctcatgccctcatgtggcatcgtgcctgcctcaggagctctccttgtcctatgtagatgaagcaggcatgattggcaggggtctgctctgccctgcctcrgtccccacctcttctccaagctgtgccaaccctccgggtctgactgctgcccctctctcttaggaaacctctgccccagcccrgggaacacaaggagcctctccaaggcagaggaccctaagcacttcttttttttrttattttttrttttattttaggttctgagatacatgtgcagagtgtgcaggtttgttacatagctatacatgtgccatggtgctttgctgcacctatcaacctgtcatctttttaagccccacatgyattaggtatttktcctaatgctctccctcctcttgcctcccaccccccgacaggctcggtrtgtgatgttcccctccctgtgtccacgtgttctcattgttcaactcccacttatagtgagcacatgtggtggttggttttctgttcctgcctaagcacttattataggccaggcactgtgcaggcacctcatcatctcagtcagtctgcaccgaactctgtgcagtagatattattatatcctcatttatcagattaggaaactgaggtgaagcaagttgtccaaggccacccagctgttaaatggcagaagtgggatttgcacctaggtgctcaagtgcattggtttgccaccatgtgctcaaagagaaggggcacaagagcctcatgaagaaggcatagctagcctgacagtccaaaggccagcagccgctgtggccatgactcacacacacctgcctcctcccagaactgccacgtgggtcctcacagctctgtccttatcaacacttactctcctttacaggtagcctaggccccagctcccagctctgttcgaggctcgcagaggggcggtagtgaaggggtctcatttctccaggatcctctttgctctcycgcccggtcctggtccagcttccctttcaagcatagtgaagtgcatttgttagcttgcagccaaccctgggaaatcatgagaatttgttcccaagtcaactcattctccagcrtccacagtgacgtattcactcacccagttgagcgcctagtgtatactagaccctgtgacagcaacaggagtgcaaaggtgactaagacgtggcccctgctttttttttttttttttttttttgagacggagtctcgccctgttgcccaggctggagtgcagtggtgcgatctcagctcctcacaagctctgcctcctaggttcaagcgattctcctgcttcagcctcccaagtagctgggactacaggtgtacaccaccatgccggctaattttttgtatttttagtagagacggggtttcactatgttggccagggtaatctcgaactcctgacctcatgatccgcccgcctcagcctcccaaagtgctgggmttacaggcatgagccaccacccctggccggccccgcttttaagagaggggagagaagacctrggccttagaagagctcagaggaaccacaattgactctgcagtcaaggagaggaggctcactgcggatgtggtatttgagccttgaaggatgagtgtggtttcatcaagtaraaaaggcagggatgggaaagggaggtggtccaggcaggggtgatggtgtgggcaaagccttgctgatattaaagaacatagttctgtgcacctggaacactggatgcatggggtgcattatgaaagatgggactgaagaagtgaacttggcttagatcccatgtagtaggtctgagaagtaagatttaacccaaaggttgcaaaagaaccatgcttgtgataaaggatgatggattggggaaacagagaaaaagacagacagactgtaggaagggaggtattagcaaataatcataacacagtgtgaggtgtgcattaatattcactcattccaagtattgatcragaagagaggtaggtactgggttaggaaacagcttgggcaaatgcatggggaaatgagagatgtcaagatgcattctaatggcagcctcttgaagatcttaagttgtttytggttcactcatttcgcaaatgaattcatttagcaaaagcactatggatacagtgcttacctctaggaagtaagttttagcccaaatgctgcagaaggatcatgcttatgacaaaggatgatggactggggagagagaaaaagaaaagacagacagactccaggaaggaaggtcagtctgcagctccttatagtggctaggagaaggagtctaggcagatacgactcaattagcttcatctgctgtttgtctctcaaaatctagacatgtgcactgctctggctggcccacctatcctgggcattgagttaagtgtgggggctgtgtgttgagagtccccctccattactggcaggaactccacacctcagacattgagccccaggtctgcagggagaagacgtgcttgcaaagtgagctaaaagcaaaacagcctytgacctggcaagcattcccaagtctgcacgcctgcagccagaggagagggtgatgccaggctgctgctcagatgcttttcagccatacccaggccaagacctggtgaccaggcagccagaaggagttccaggaggcacaaggcaggaagttgggggattaggaggtgtagaatggagaatgctctggggagatgggtgctttgttggtgcaactattcgtttattcctccagtgaccaygtgagcagtatggctgcacacacaggctctgcagccaagctgcctgggttcacatttggtctctgtgctttggaaaatttcataagctttctctaccagtttcccttattacccatgagattgatgtgaggattaacctagcatgtagtaaatatcctataaatattattattcaatagtgtacttctttgccaggaacaaaattcacctgttcctctttaaatgtcctccagtctgtctcctgggaaagattcttgtgagctccctggggacagggaccatattttgtttgtctcactgtatccgtagtgctttttgctaaacgaattcacttgctaaatgaatgaaccaggaacaacttaagaccttcaagaggctgccattataatgcatcttgacatctctctcctttccacatgcctttgtccgagctgtttcctaacccagtatttcactacccctcttctccatcaatatttggaatgagcaaataccgttagtgcatacctcacatggtattataattatttgctaatgcgtctgtctcctccatgactctgagctccttgagggattattccatgttgtaccccaggtgccccmtgcagatgtgtattttgtgcactgttctgtgtaggctacaaaggaaaaggcctagcacctgcccttggggagctcacccacccaggrtggacagaggtgtgcagacagagctgcagggtgggcacaaagggtccatctgctgaagtcctgcagatgcagccccgagcttgtccctcacrtcagcagcctggctcctggtctcagagagaactgtgtggttcccaagcattcactttaggaagaatcacttgcccctccctggctctctgcttcaaggaactgtgwcaaccttgggatttgcaaactctctctttaatccttaagaggaaaatgttttggtaaaaagtcaagattagcagatacactcgggtgaaattctttccctggaaataaagaatagagccattaatatccacagtagagtgactttaaatgcccccgggggrtcagcaggaaccagggccctgaggaaaggatcagcgtggggaagaggctcccacttccctgtgaggagctgcacatgcagtctcactggagctccctgctgcaatgctgttgcctgtggtggttggtgtggatgctgcctgccaagagccctgattccccaggaagagagaaaaaggcttctctcaggacggccctggtcgcatctgcctgtacaattcctggagcctttggggagctgaagtcaggggctcaagtgcccctgggtttcctggaggaggcaggtgtggtgagacagctgacagacaggagaagggatgctctgaggaagtgactgtccagccatgggaaccagatggcccctggctgtagtcctgaygctgccacttgctagctctgtgaccttgagcaggttacttcacctctctgagacagactcactgtctggacaatgagtaaaaccctacctttcytgtctcagagatttggcaatgggacccaatsacatcaattggaaaggatgctgtgggtgaaaggtaacctttcaggacagcgacaagcctgtctgggcaggatgaatgggctgtggagccctgtatatcctagctcactctttgaacctcagtttccacttcttccctttttatttattgccggggtcttaaatgagtgttgggggtatctgattctccctctgcctgtacttttggggccaagcactgagctgaaaagacaattcctcctagttctccaagcctacaacctgccccctaaccagctgtgagctgtaatacattctccagtgtcactgtgaggtttgtgccttcacccccattttatagatcaggaaacagaggctcctccaagtaaaggagcttgcctcagatttcacagccaatgagtggaaaagcctctrggattcaaatgtcagagcccatatttttcctacttctcgcacctgttatcatatgctgcctcttcctttaacctgcagttccctcccttcacctccaccgtctcaatccttcccactctttaaggttcagttcagctatgacttcttctatgaggcyctactcattttctcagatttcttcctcctccaaatttcttgtaaaaattatgttttttctctgattctaaaagaatgcacattacattagaaaagatacacaagcatacagaagataaaaaccacctaatatcccatcacccagaagcttccagtttttctttatgcatttgcatatgcatttgtgtttacttttccccaaaagttctccgatactttgtcctacttttcttttgacscttataacttcctgacttcggtacctttctgatttgccctaccagagtgtgagcccctggaaggcagcctctgcaccctgattcaggttgccacacatatgccagctcctagtgggctggarggaaggacatgcggttggggaactggaagactcatgctttcagctgtgtgcttcctccctagagtgcaggcagaggaggaatcgaatsccctcagcactcttgtaaagaccacagcaatgagtgagagatggtgcctgccagacataccattctttacttttcagcttaaaacagatacaaagtttggggaggctcactggaggaggcttggggctacactggaaagagaagaacttggattcacaccccagcttcccctcttcccagctctgtcacatttgcaaactctgagtctcagtatcctcatgtgtaaaatggggatagggtttatagggttgtaaggatgagatgatgagttgtttgcaaacaacttctcacagtgcacagtgaaggycagcaatgagagccagccccgccctttcttctttccaaatgattaatatatctgttaccagcctccattcattatatagctctgtcatgtgctaagcaccatgggggctgaaaaagatgttcttcctgccttaaaattccactggggatgaacaaattacacgggagctgatcagagaggaaggcagtccattatgagggctaattgagcagtgcagaccatgttgcaaactgagttagggccyggagagcttactgtgtgctggggtcctcaggaatgccacagatgcatcaataaccacctctgctactctggaagtagtcacatcaggaagactccagagataagcttatctgggctgtggccacagagctggaatttgtaagctttaggtttctatgtctcatgttaccagcttgtctataaattgtaaattacagccatctgatggttagggaatatgaagtttggttaagagaatgaaatgagaccacgaagattagagaacaggaaaagaggggactggggactacatacccatcagaatcttcattcagtcctgaccctcagcaggagggggatttcatcaggctcatttccatccttgatttcgtccatcctggttctcctgacaaggggcatttatcagagttatggcatgggaaatcacaggggagtaatgtaccatggcatttaagagtatgaacgttggagtcggagctattttctccgctacttactagctgtgtgactttgggcaagttacttagcctttctctgagcctcactttctttatctgtaaagtgagggygatcaraataaacctccttcatatggttattttgagctttataaagagacaatactggctgagcacggtggctcactgccagtaatcccagcactttaggaggccaaagctggaggatcgcttgagcccaggagttggagaccagcctgggcaacatagggaatgagactcctgtctctacaaaaaatatacaaaaattagtcaggcatggtggtacrtgcctgtaatcccatctactcaggaggctaaggcaggaggatcgcttgagcccaggaggtggaggttgcagtgagccaagatcacgccattgtactccagcctgggcaacaggagtgaaaccctgtctgagagagagagagagagagaaaatactactatggtgcttataaaagttcaataaattttagctgttgttagtattattaaagtaagatctgtatgaaaataaagcagattttttcccccaaatgttcatgtcagaagtatatatttcattggcaaggggctgcttctggaaggttgagaggtatcctgggggaggggatagagcactggcaaaattggcatcacaattcaagtcacctcactcagtgttttttaagttatcaaaatccacagtatgaaaagcatttgacattacagtccactatatttatgcatttataaacaagagaaaaaatcacgaaaaatacagtaccacgtgcagtacacactgattccatctattctttttttttctttttcctcaaatgcacttgccgcctacttatkccagacccaatgattgggtccctatccacagtttggaaaacactataagaaatgattgtgtcctctcactttccctctctgggatttagttttccaactataaaatgctcctgatgcccagccagcctcaccgctgctccgagtcaatgccaggaacgctgatttagcacatgctatttggagggtacccatccaggtgctgtgggagggacagagattgagaagagtgctttctgaccccacagaggccatttggaaaccctgggaatgggtgggagggttggaggtggggattgcttctcccctaagactcagcgtgatggaaaggcaatggggtgggaactaactggtgttggtctgtcccatttgtgtcccagcagccttcctgacagcgagataggagaggaccccaggtacagccttgggactgggtcagaagtgggtctcaacaaagggaaggggtagggtgggggtggaggacttgtgggtgggtaatgctgagtatggattcagggatgtgcagcctacatattttcagagacatggggctaaggcctgcattctcaatgagggcaaaatttggttcttggggacagaaaacacttagacattgcaatgctttgtggctgtccaaagtaccaaacagatgccagtatatctgtggtgctgaaatttcatggtgaatggagtcagaaaatagactagcgattgccagggtctggtgggagagagagggaagggactgccaatgtgtatgggatttgttttggggaagataaaaatgttttggaattagatagtggagatagttgcacaacctggtgaacgtacttttagtttcagaggttttctaaacctctgatttttttttaagtgacaggaaagacagaaaaaagtatatctaaaaaggctctaggggtgatcatggaaaagaaagttaagaaatatgactgtaaggaaaggagatgggtgtccctcaggccaggcagaaaattcagtcttgttgctttatgttcatgtgcaaatctaaaaaatccaagtgatatagattaatgaggctctgrgtccctcaaaaccttccctccccttacctctccaaaaaacrcttgagataccctagaggtggtatgaagtcaggatgggaaggttggctcagctttgcaaataagtttaagcctctggcctttgctctccaacaccaaagaggcttcactttggtatattttctctgccctttctccctccttgtccccaactgtcagtatgtgatgacaggctcagcctctgtaatggtagtgatcatatttcttgagccaaaaatcagacctcatggcatgtgacaagtttgcatatgtggatgagaacagagtggcagaatatttgacacgggagcagcttgggcagtccagggcacatggcactgcacctgacatccctggcagatcccccacattccgtggttgtcttctgatggggccatatggggctgcagatcatgcctggagccctcgcagctccagggctgcgggttcccagccccagagtgcaggtgctggtgtcagcctgcctggcctggcctggctctgtccagagcactccttgccccagctgtttgtgcagctgtatcagcctcagacctcagcctattcattccaacctgaatgcagaggctgggtctggaggagccacattgcgggcttcatactcctgatctgacaagttttccccccagagcctgcaccaatggcacctctccccattctccctcttaactgggtcctccagggccctcctcacacacccacgtggtcaggcagcagaggcttccccaagatgggcacaccccactctccacacctctctatgcagcatttgtggctacagactgggtccaggggattgtaaaggcatgctcatgttgggttggagggagctcagratcttcctggaggayatggttcactcccatgagagctcagtatgcctttcctcccctgctgcagcccagagcgggagacagcgacygacttggatatcaggtactgcgtcctgggaacattgccccccagggtcaactccctccagggtgctctcaggyccaagggagccacatcaccctgctgggcagcccccagaccccagccccagtgttgggggaggccagggagggcccctgtgctccaccaggtggmtcgggagctgctgctgtttctgtgcatccatttactcccttcacataagatcatttttatctgggatctctttttcttttttcttcaaaaaccacatcactcaaaatgtggcttccttggctctgcttttaaaaaaaaaaaaaaaagttcttccatttggagaattacctgctgacttcaaagtccagtggcttgagggctacccaaagagggaggaagccagaagttgagtgttcccttggtttggtcacacttttgggctcctccctgactaaggaacaacagactgcagggctggggcaggctgggtgtagggcagggaggggatgaggtcctgctgccccagtcagttgagacccagacctctcaaacctgcctgggggaaggcaaggccaccagaggccacactaagcagatttctaccaaytgcacctccccatccccttgcctccatctgagccatcagcttgacaactgcctctgagaacaagcccctgagaatgcytyccgcaccccctactcccgccctgctttttccaggaagagaggccccgtggcctatgcttcgcagaaaccatggctgctaaatgccactgtggaggagaacatcatctttgagagtcccttcaacaaacaacggtaaaagcctgtcggagggaggcaggatgtggaggggaggaactgtctctggccagcctgccccagttccgggcccctccatcgatcacccayacccagccatctcactccccaggtgcttayctgcactccagcctctccatatggtgcacctggagaggggccaggtgtgcctgagcaytggggcaatccagctcccataggggagagggcaggaayggagggaagggagagagccccgctgccttttctctagctggtgggagggctagctagctctctctgtgagtctccattcgcctggctcctgcactattttccctccaatgataatagttagggctagcatcgactgcgctcttactacataccaggcacagtgccgagctctttgtacacggaatttcctctcatgcttacaacaacctcagtaggtagatattattgttattcccactctacagatgaagaaccaagtttcagaaaggtcccaaggccacccagccagtaagtgaccaagatgggtctcaaatccaaagctgcctaacacctaagtacatgtttgtcaccaacatactctgatgcctccatgaactctggctggcacctgcccaggctaagggctggctggggaagtatgagaggaacaggctgggcaaatatttgaccagccatcatcattactgcctaaaccaaccagcagtggttttccctgcagtgccccaagcacgggttccggctgcagcttttcccactgcacagagatcatgagcgccctttcatcacttactctgcatatttgttcccaaccaattccatccttctagtatttaacctgcccaaaygctgtgtgaagtgctgacctcarctcttttcaagctcacacggtgtttgcttgcacccaagcgggaggcctattaaagccattgctcaccctgggcatagctacccagagactaatgaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattggggaacgggttagtagcagcctctgaggggttttttcaaagccaggacccccaacctaccatgccctgagacactactcaggacaatgggtaactaggaaataggagacattgaaggctgaagagttgcctgcagtaaggtcaaacatgttgttcttgatgatgtcctttgacaggttttcagtcctgcttggagggcaaggtcagcttagtgccctcccaggctggggatcttcttcatttgcaccccaggtatacactgagagcccacacagcactgtgctcagcctggggttgtattgttcctgttcatcctccagatggggtcccctccacaagcttagacraacaggattctcctgtgactgtcctccttttgtgtgattttaatccctgctgcctctgtctttgtttgtactggtcagatggtccctagcgcctacacaatgaatctttaaagacttggggctcatgctgccctcttctgaatgaattcagtaaacacgtgcaagttccttctctatgcaaggtgagaagcaggcaaagaagtggatagagccaggcctccatcccaaagagctcatagtccagtagggtacaggacagtgtctcctgaatggctgagggcatgatgtgttcctcctctttggtgacagggcatcaacytgtctggtggtcaacgccagcgaatcagtgtggcccgagccctctaccagcacgccaacgttgtcttcttggtgagtgcaagttcccttggggtcctggtctctggctgcctcccaggcctaactgcccacctccacctccccgcaaccccaccatcatccaacaatctccctctccaggagtaaatccctcctgccagagatattgccttatcatcctagtgatagggaaactgaggcaggcaaggatagcacaaatgacccattgcagacttcagatggagctctgcagtagccaatgaggagaggcaagctgtagttataggctgcctgtctgtgggacagcccaacccctcaacacttatgcagcccgactataagaatggctgataacagaatgtgtgctgccacttcccatcttaygcccagtgcagacattgctaattgttcacagcattatttcccatggaacttaactcatcctcagaatccttctcaacacagcactccaggtaaccactagccatcaaacatgagataaaactagrccaggcgcggtggctcacgcctgttattccagcactttgggaggccgaggcaggcggatcacgaggtcgggagatcgagaccatcctggccaacacggtgaaaccscgtctctactaaaaatacaaaaaattagctgggtgcggtggcgggcgcctgtagtcccagctactcsggaggctgaggcaggagaatggcgtgaacccgggaggcggagcttgcagcgagccgagatcgcaccactgcactccagcctggggacaaaccgagactttgtctcaaaaaaaaaaaaaaaaaaaagaacgtattcgcaatccttacactacttcatgtcaagttctgttgtgtcaggtgccttgactgacactgaagaattctaagaaccagtccttggcctcaaagatttagaatctgattagggagacagagctcacccagttcaagaggmccagcccggttcaaatccaaactgtgcggcataaactatgagggggccttgtccagggagacaactgtgagggctggagtaatcagggagggcttcctggaggagagcctcaaagggagagtcaattaaacagaaggaaagagggaggccatttgcacagtgagttggaagaaggaagctcaagtctctgattccagctttaktccctcccctctccctacaccacacgcacaagcactcctttactaaagacacttcacagtgggaagattcagtctccgttaccgtctgacacacacacagcgttttacaaagcatgggtgcattcgcgatctctcatgagatttaaacaaccctgctagagaaaagtgaagtggacattttatttcagtaaacgtttatgaagcgtctactctgtgccaggcactaaacgtttatgaagcgtctactctgtgccaggcacaggcacaagaagtctcagttcttgggagtgccataatcaggaatggacaaacaatgatcagatctggctttgcgccagtgtcacgggaatagggaggaaggaagggtaggcgtgggggtcaggacaggatgcaggaggaactggtgcttaggtgagcgaaggatgggtgggagttcacaaggcagacaaaaggcagagcagcactccaggcagaggaacagctcaggagaaggcccagacggcaggcttcctgggaacctggaatgcagagtgctgggaaagcacagatgaagcatgagtctagaagggaaagcgagaggttataaagcacctggaacaccagcccacagggtttgactttagagatgatggggagccgttgaaggtccaggagtcaggcagtgaagtgattagatctgtttgagagtgatatctgacaactgccccattttaaatgaggtaaccaaggcccagagaggttgggtgagttgtccaaagccacacagctaactagcttcagtccctagagcagagttgatagaactctaatgggttttatactcattgtcacccctccccaccatgcctttccctaccctctactctcttcctctcccttctgcccaggatgaccccttctcagctctggatatccatctgagtgaccacttaatgcaggccggcatccttgagctgctccgggacgacaagaggacagtggtcttagtgacccacaagctacagtacctgccccatgcagactgggtgagggggaacaagggggtcaggctatagggggcagggctggggaggctgtcaggcatcttggcaggaaccaatccgttgtcttggtagcaactgctgagggccacaaagcataagagaccagcactggatggctttatgcatgctgggcatttcagggagaccctgtacaggccaggggtttggtatcacctagacccacagacactccccatcctggccygggccccccatggtacactcaaggctggcaccaagaagtctcaggaataatcaagtgctcacttctcaccttctgattcctgcccttttgatgacccatccccgcagtcatggggagtgcccatttggatggaaaagccctcttcccaccctatgaccttcccggggtggawggatgcaccaccccgggaatcatatgggaaatatggaaccaaacaatagcagtagtaatagaaacttcaggctgggcrcaggggctcacacctgtaatcccagcactttgggaggccaggacaagaggatcacttgagcccagaagtttaaggctgctgtgaaccatgatcatgccactgcactccactacagcctgggcgacagagccttgtctctgaaaatttgaaaaaggaaagaaagaaagaaagaaacttcaatattatcagtagagtccaatgttgtgaaacccctcattaactaaatttccatactcttcagtaggtagaaaataattactttttgattcattagaaagcacttaatttttaagatggagatcatgtaattttgaactctaggtcttgcctactcctatataaattctcctctaaacaacagccaaaattgaggccctctytgagcttcaggctggtgccaaatggctctgcttattttccccaaaataaatcttccttccatgtatgatgagaccccctccagtataaagaagacccaaagaaaatcacccaaagaaaaaaggcccaaagataagacccaaagacctaaagatttaaatatatatacagatacagaaggtttgtttctgagtttctgtagtgaccttggcaataccttgtagttcaggacaatcctgaggaacacagaagtgctggcttccttgaggaatcagtgaycaggactctcgagccccttgaaccccakcatagggygggagggggtgagggcagcaggggtgggtgtctgaattaatgtcaggtctacgtgatggtgtcatcaagtgttccagataaaaagttttattgagccgggcgcggtggctaatgcctgtaatcccagcaccttgggaggccaaggcgggtggattgcttgagcccaggagttcragaccagcttggggcaacatggtgaaaccctatcwctataaaaaaaaaaaaaaaattagccaggtatggtggcrtgcacctgtggtcccagctactcaggaggctgaggcaggaggatggcttgagccaggaagcagagattgcagtgagctgagatggtgccattgcaccccagcctaggcaacagagtgagaccctgtctcaaaaaaaaaaaaaaaaaaagatttattgattccaaagaggcatggccacacacacttagaccagcaggtgctttgctaagccctgatggaggctgccagacccgccgtcaagaggagctaagggtagtgtacaatgagcccacttagtgtatgacggccgctgccgtgggtggagtccttgtgagtaaccagccagcttgagcaggatgcactaatttgctctgcaaacccagccattgagaaatacgcctcagatgtaccgaactctaggtcctaggagtatgttggttggggtaggttatcaataccagcccacttgcagtggatgagctggtggccatttgtagtgaggaaagggatgtgtcaacctccatcttagactccacaattgagggatgtgaccaccattcctccccagccagcccccaaaccacgtttgttgctgcctttccagatcattgccatgaaggatggcaccatccagagggagggtaccctcaaggacttccagaggtctgaatgccagctctttgagcactggaagaccctcatgaaccgacaggaccaagagctggagaaggtgggtatatccagggrtggccaagcagccacccctggatgcaaaggttctgctagaacctgaactyataaaggtcttcctgtccttagtgccccaggaagccccctaaagggcagatgtgrgagctgggcatgaactggctcctaccagaggagagacagtacctgtgccaggtgcccagggcagaatcaggtgggcaccttcgccttatcctgaggtagtcagatactatttagttgcaaagtttcagaaaatcaactcaaactggcaaagaaaactaagcaaagaaaacaagagggaattaaggatttattgacccatgaaaccaaaaagtccaggtgtgtcatagctttaagtgtgctggatccaggtagtcagtgtaatcagaaatctgtttctcccatctcttgactctgctcccctcaaattggctcagctcccctcaaattggctccattctcatggtatcagtgagggccaccagcagtcttaggtttacattctcccagctcaacaactctgccagaaaaaaagtgcctctttccccatagttcagcaaaagtcccagggctgagtctcaytggtccagtttggtcatgtgcccacccctgaacaaatcactgtggccagcggtgtggaatgtgaggattggcctgtcctgggtcacgtgccactttgggagccagatccacctgaatcacagagactaaaaacaggggaagagtggttccccacagggatatgggggtgctattatctgatgaaggggaaggactaaatcctggcaagatgaatgtgtgtctgtctgcccctccctcaggcagggacaaagtagaaatctgacattggtcatcaccagagtagttaccccttaacttccccttcccccaccaaccatatatcctgaagacattgcccaggccacatctgtcttttaggagactgtcacagagagaaaagccacagagccaccccagggcctatytcgtgccatgtcctcgagggatggccttctgcaggatgaggaagaggaggaaggtacaggcaatgggactgggagtgaaattatggcctgaggtctgatcagccacagagaggctaaggtttggggttctgggtgtggtgcagtagtgtgcctttgattaaatggcttccctctgtgtgcccccgttgtcccctcagtaagtggggataaaatgccctgattcaccctcagagggatggaaatgtgtagccacagagtgggttcttgcggcctgcagaggaggcagctgagagcgaggaggatgacaacctgtcgtccatgctgcaccagcgtgctgagatcccatggcgagcctgcgccaagtacctgtcctccgccggcatcctgctcctgtsgtwgmtggtcttctcacagctgctcaagcacatggtcctggtggccatcgactactggctggccaagtggaccgacagcgccctgaccctgacccctgcagccaggaactgctccctcagccaggtgtgactggcggcccatggcagaggttgggagtggggatgggggaagggctgagcccatgggcaccctggaactccaaatcactctctgcctgtgaaggagtgyaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggtacccgtctcccctggccaggctgggactgtgagcaagtcactgttctctgagccttagtcttcccatctataaaatggggatatacaacctgtcacaagcttgtgggggtgactcaaggagacagtgtgtgtaaaagtgccctccttgtgcaagaagcagggagaaactggcatttactcagccagatactgtgataggcattgtgtgtggttagctcatttaattgttaccatggccctttaaagtgagcgtctgcacatccaastaaagattgttttctcctccctaagtgggtgtaatttgyccatccccacccatgagttcagctccctgccctcccctcrctctctctccctcagccagcctcaggttttgacactgggggaacaggtagctgttctattaataatttcctgtaatgggatggataaaaatctcaaaggccacttgatgtcaaagaggtttaaagttgtccctgcccaattggttggccaacttggcttaaaaacacaacaggcaaacagattttctggccccttgtcgaggctagacctcacaatctaactgcactttttactttccagcctcatgagttttctgtggcccacrgatatggcctccaagtttatttacttttactctctatttgccccagctctgtagttctgaaactccctggttggggttgggctgactctgggtcagccagccggcaggctgtccccagggccctgttcctcttggcaggttgtccctctggagaggactctgtgtcccaggaggacagctgctgagtcaggccragccggcagctgagaaaggcggcagtsgtcagatgggcttgagaaactgaaaggctaacgaaaggccagcgcccctttgggcagctgcaggaattcacggggatacaggccagatgtctacaaattggcagaggatgccagacccatgaatgactccagagacacttacatgaaataattaactatctcattcagtaaacaggaagtaaatcaatggacaaatgagtaactcttcctctggctgcctcttaggttttttgagaccacgccccttgggagcatcctgaacagattttcatctgactgtaacaccatcgaccaggtacagaggaccgtgccacactatccccccttccagagacacctmggacccctgggggcttctcctgtctgaggctgggttccccagatcaggtgatcacagccctctgggaagaagccagtgtccccgatccgattataatgctgcttcagggctggggcctccctcgtgggagcctcacagtaaggctgagggaaaccagatccctttagcttccacctgagatcccactggctttctctagtaaagttccagcatattctgaaccaaggtggctgattgtatggagaatattcattttgattcagcctgtgttctttatttaccattgtaccagatggtgtgaaaacaaaatcttgattcctacctcagggagtttaccttgtagctggagagatgagatacgtgcctataataaagggagagcaaggccgggctcagtggctcactcctgtaaccccagcactttgggaggcggaggcaggcggatcacttgaggccaggtgttcaagaccagcctgatggccaacatgatgaaaccccttctctattaaaaatacaaaaattagccaggtgtggtggcaggtgcctgtaatcccaactacttgggaagctgaggcaggagaatcatttgaacccaaggggcagaggctgccgtgaaccgagattacgctgctgcactcaagtctgggcaacagtgagactcagtctcaaaaaaataaaggatcaaaaaataaagtgagagcaaaacatggcggccagtagcactctaaacacagtcaataccaaaattcacctcactctctccccctcgtctccctcagcacatcccatccaygctggagtgcctgagccgctccaccctgctctgtgtctcagccctggccgtcatctcctatgtcacacctgtgttcctcgtggccctcttgcccctsgccatcgtgtgctacttcatccagaagtacttccgggtggcgtccaggtgatggcctcaggggtgaggggtgggaggtgctttgcaatgtgcagtttggtgtacttgctagactcatcgttatgagagtaatagggtcgtgttccctccaaaaaataaaaacaaaaaacagaaatgaaggaaatagaaatatccacatcttattccaccgccctaatataatagtctgccaacacacgcacacactgaggttgacatctgaattatttccttgggcgatatggtcaggactggaattgctaggtcatgataaatgcacattttatgcccttcattcattttgccaacatgcttcccaggagggttgcatcattctagtggtcaggctgattgctgatgcatgaaatcggcgggcacctgattcaagcagtgttatgataacacctcccagcccacrtgagtccagagtgtagctgtaagccttgacttgagggagcctctcacagccattctcatggatcacatttgccctcatgagctttggatccatgcacgcctctttcctcctcaaaattttctaagaatgttctctagggagttctttctgggagtgattctcccagattcatagaaactcatagattcaaaaaattgtaggaaaaaatttaaagaacgtctaggccagtgtttctcaaactgccaattacagcccatcagtgggtcatgaaatcaatatcatggatcacaaccagcatttttttaaaaatgaaaaaaacatcagactgtattcatagagtaaagcaagctttgcttcatgaaacctttgtgttggtcatggaggtgtgtgagtactgatttgtgagataaaatatatttctgactgcaggttgtggtcagaaaggttaagtacctttcccaagtgcacatagttggctagaaactagagttgagatacttattagcaataataaaatttagatgcattttggacacaattacctgccccaaaggatcaacatttgtataaatggctttttgcttggatgatccagaatggcccgacacccacacgaacaacatagctttttgacactcaaaaaattcaaagtgctgcacaarctgttctacaaagttcatttcttctgccagagaaacagcccagtctctgtggcacccagtctgaccctggagatggtttatcagggaaatcaacttcctgcatcccaaactggcctccctggcactgatgtgcttgtcgaggtgcagctttggggagcaggaggcaattctgttgccatggaaacctctggccttaccccgagacgaaacctatcatttcagcacatcactggccagggtctaaagagctccttgatggggtaagcggaagacgggrttgaacgctttgagtttggtcttctgttcctttggccagctgtctcaaggttcagattgttcacctgtaaaatggaactagcactgcctgcccagccttagctcagctccaggctgtgcagcagaagtacagggacagatggcgacctggggttgacaatgcccaggacagcagtaattgtgccccacatcaggctgtgtctaagcattgtacataaacgatctcattcagtgctcacaaaagctcaatgggctggtggcattgtcttcccccttcacggggtaagaagctgaggcctagagaggtaaggccattyacccacacagcggtagcaggtggagctaggcttcaggcccaggccgagccctgagcctgccctcttaactgttccactctgttccccgccacagggacctgcagcagctggatgacaccacccagcttccacttctctcacactttgccgaaaccgtagaaggactcaccaccatccrggccttcaggtacgagtccacattcccccaaggtaggagtggaacaggggtggggccagggggcacaggccatgagatttgattctcaggactccacttgggaaggccaaggacacgttctctctcaagctgcctcaggtcccaaggcccaagggatatccaccagcagggacaggccaggtgggctcccactgaatgttctagagaggaaaattccagctctgtagacaagcccaggacctctgtgaggcagagcatgaaaagagacaaagctgggacaagtcttcatgtatcaacgctagaaagggccttaggtgcgggccaccctaagcccttcttttattaaggagcccctgtgtgccaaacactatgctgagtactgtacaggccaatcccactcattctgcactgcaaccctcggtgctgagaatggtcatttccattgcacagacaaggaaactgaggcacagagacgttctataacctctctgtgtaaggtgccacaaagcccagacttgaacctatttgttcatgcaacaaacatttactaagccccgactatgtgctaagccccatgccaggcactaaaaagatgagtcaaataagccgctgccctgcaggcgtttacagcccagactttgagcaggccaggataaatccacgtgacaagtattctgaaaaaagcggattcaagggctgtgggagcatagaagagagacagtccgggaaggtttttgtaccagaggtgtcatcagaactaggactcaaaggaggggcaggagttcaccaggctgaggaattcctgaaaacttcagtgcccctgccatcrtctcactaccctgagtggtgatgttggggtggacaggagcatctgaggttgcctggggaatgagggaagctgttgtttcccactccccaagagtctgtctgatctccagaggcatctctcttccagtcaggcaggccagagacccctgacacacaaagttgggctcttttctcatcttcatccagagagtgataataggttatttttagggtggcacagctgcacgaagtatgacagtaaccatgagacaccaagcactgtgtccaggagtaaccatagggcacaaggaccagccaagggccagagaggcttacatctcctccccccaacccctgaagtccagcttcagccctggagaggtatccaggcccctctgcccaccctggagcacctagggccagtggaaatccacctcttagggatcttgtctaaktaaagaagagcagagcaaagctctgccctggccttggcgctgctccctggacatcccttgcccctggacaagcctatgctgtgtcttccacaaagaagcttgctggggactggattatgactctagagtctcctcccagcctcctcttctcaagcctgaacttctcccgttccttcaacttccaggtccctcgacattactgagcctagcctttgctctaagttttggtgatttccctctctcaattggtgtctcagagggccctggggtagagagatggtgactcttctagagtgggccacagccccttgtgtgcagatcccagcttcctgtaarcagcctcagatcaggccaaacctgtggtcagccagagccactgctacccagtgaggtcttccacaccctactgacacggtgaatgatttttaaatttgaatgaaaggctttttaatcaaccccatacacatttaatgcattggctttaatccagcagcctgttgagagctattagcacttattgattgcccacttactgyatgccaggcaccgtgctaagtrttgtatgtgcattattacatttaatcctcacaaggaccacataacataggtacgaatcgccacattctccagatgcagaagcgagacccagagaggctgggtaatcaatccaaggtcacacagactgcgggggctggcgctgagcttggaacccaggtttgcctgaccttctgggctttcctaagagatcttattttttcccaaaagagtttcaagagtgcccagcactgggctcagtggcgggctcggaggttgttttcgttcatgtaggaactatcacttccccatttttttcatragaaaactgagtctcagtcctgatacacagccaggaagttgtgatgttcaggctccaacctgggtttacatggctccgaggctggggctcttttctagtcctcagacacactgtcgcacgcctgtggcagaagctcccatctcacacttgccgaccctcaactcacacagtcctgagacccacatacgctgagcgcctcacactcctataacrcgcacatgccctgatgcacacacatyttcaacacgcacttactctacccttcaggcatggtttcacactcactgcagacacgtcaccctcccacaygtctccaccctgggggtgtgcagtagcatgctctctcccacctcagaacctcccttcagtcccctcagacacatgmcctctctccacgcagagacaatcaaagctgaactaacaccttccagggtgaaaagcaaatgcccagtaaggtacgtcttgggtgcctccgtgtcccctgagtttggtcctatcaaaccagcgatgatgaggcagcttttctttcgttccttcctccatcatcaaacaagtgctcctgcatctcctctgggccgggcctacgtcagcaaggtctgagggaagcggccaaggagagtgatgayggcagcccaggttgatcagagaaaggaggcaggtccatgcrcagtaactcagggaaaacatgatgaggacctaaggatgagaaagaagcctccagagttccctgtgcagagagattccatcaatttcagagggtcaggggagtgccatgcattcatccaacaaatatttattgatagtgccaggtgctggggtatattggtgaataaaacatcttcatggaatttgcagtctattgagggagatgattataaatagctagagaaatgcatgtacagcagatactgtggagcaaacaggttgcagacaataataggggaaacctactttatagtaaggtagtagccaggaagagcctctctgaggaggcagcatttaaggcaagccctgaaggttgagttgagccagccttatgaagagcaagggcaaaagccttccaggaaaagggaatagtgtgtgcaaaggccctggggtagggaagactttagtattgtcacagagcttttaaaaagctgagtggctgcagcatagtgtgtggggtgtttgtggcaggaattaggttggcaggagggggttyttcatcctataagcagtggaaggtcattaatattcttttttatttgtttttttttttttttttttttttttttgaggcagagtctcactttgtcacccaggctggagtgcagtgaggtgatcttggctcactgcaacctccacctcccgggttcaagcaattatcctggcttcctcagcctcccaagtagctgggattacaggtgtgcaccaccatgcccagctactaatttttgtattattagtagagacagaattycaccatgttggccaggctggtcttgaactcttgacctcaggtgatccgcccgcctcagcctcccaaagtgctgggattacaggggtgagtcaccgcatccrgccggagatcattaatattctaaacagtgggggagaggacacagtttgcgatttagatagattaagccagccactgtgtggagcatggactgtagggagacagcaggtagacgtattcaggaagctgatgcagtagtccaggtgagagtttgtggtgggcaggaagcaggatagagggggagggaggcaaggactcttttagagagagacataagaggacttgccaaggggctgaatgtgaatccaggtgattcctgggtgagaaactgggtaaagggaggtgccccttattataatgggaaagacctagagaaaatggrtcttggggtgaaaacaagagtttggaggaggtggggattctggacaggtttgaataagcagaaaggagtggggtggacattccagagagggatagcttacatgaagtggccacggtggcatgtctggggactggaggggccctggagcctccctctgcaggtagggagactcctaggagctatgtggaccaacactgttcccttaggagcttctcatcctccctccaggtatgaggcccggttccagcagaagcttctcgaatacacagactccaacaacattgcttccctcttcctcacagctgccaacagatggctggaagtccgaatggcaagtgctattcccctctaccctggcctctgataggagggtggggccagagcaagagcacacaggtacctggggatgaaagagaggataggataccagatcgtgtggacaccaagccttcctgcttcccccagccctggtggtcctcctagtgtctagcctgtgctccttttccccatatcactgcctggaggcttgtgtatctgaggtgtgtgccagtggcaagaacagttgtggtgaatgtgtatctgcagtgggtcatatgacacccacattgtgtgtgtttgtgggccagctgaggcgtgcatgttaaagggtgtgcaggggctagggggtaggggagcatgagcttgtgggacatgttggctcctggggctccagccttygcagcccttgtgtgtgtctggtgacgtgtgcatgagttgcagggctggagtggaggcctggctgagctgctctctgccccgaaaaggagtgaggtagaacaggggcctgtggctctaacccctgagcgcccaggtcagctcctctccctccccaggagtacatcggtgcatgtgtggtgctcatcgcagcggtgacctccatctccaactccctgcacagrgagctctctgctggcctggtgggcctgggccttacctacgccctaatggtgagcggcagtgggctagggcagaggaggggtcagacaccagcactcccggagcaccttcgtcactggagacatgagacactcccaggccttaccccaatttcatttgcatctgatgccagagggacagtgcgggcaggaaggctgaccagcaggccccagggcccaggccccagacaggtggaggttggggagccacatgactgaccctccctgtgcctccagggagggctgctctgagcaggcagtggatggcagcaaaaggaatctggggccctggcccctctccagccttaagaagagccattctggtggctgaggacagaactaagcgaccatggagtgtgcgccactggcttgctccccacaggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaasaactggccagaccaagggaagatccagatccagaacctgagcgtgcsctacgacagctccctgaagccgrtgctgaagcacgtcaatgccctcatcncccctggacagaaggtcagagcacgggcccaacccaatgctgcaggacaggcgtgagcaggggatggggcatgcacggagctggatggcttcgcagtcacctcgtgkccctccagggccgaggcctctcactattcagacatcgcagtctcctgccctgggcctgtgggggcccatctttcctctccttctattgccttcccccagtgctgccctcaggccttgtcttctcactcatccaccaaggagaccgacactctggactcccscagctcacacgggctttgtcagggcctccctctctgcgaatggtcaggggctttccctagggcactgccccgagcttcagggcagggacctgggggcagacagygaggccacccttgtattgagggtgagcccctgcctatggccctggcccagctctcctctcgtttcccactctgtctctttgyctctgtctcactttgctgtggctgtccatgtcattctctgaccttgggatgtacctctgtccctgcctctctcatccttctatgtcactatctgtctccgtattgtaatttctgttggtacccaagtgccaggaagcaacgggatcagaggtggctccattgtagggcggggcacacagacacatccatgcataccactctcagctgcccctgtgtcctcctgccacacccatgcccatagagacacaccactgccccccagctctccttcagccaagtacccggcacacccagacccacaccaaggcccaggcaaatggacatccatgcctgcacttgcgtgccggtccctgtgtaagccctctctggacccactgcaggaaacaagcccaaacctgtggtgtccaaagagaaactagtcagaaaaccaggccaaaaagataccctgtgacctcccacacctgcacacacacccagagctagcatagaggctattcccagcagccccagagtcccagyggcggtgyctgcttctctctttccagatcgggatctgcsgccgcaccggcagtgggaagtcctccttctctcttgccttcttccrcatggtggacacgttcgaaggtgagttgtaaggcgggcaccccacgtgtacccacagccaccagatgaggcctcagccctgrcacgtggtcagacatgacaggaggcccagcagtcaccgccttcccctgcaccctcactgggacccatgcagggcacatcatcattgatggcattgacatcgccaaactgccgctgcacaccctgcgctcaygcctctccatcatcctgcaggaccccgtcctcttcagcggcaccatccrgtgagccccaccacccctcaggcccacccagccccaggccggctcagttccatcagatctggagcacaaagaggagggggttgggggagaccaggatcccagaggtgtttcctgctcatgcccttytccatcccatcaggcccaggcagcctctggaaggggatcccccacccatgggtctaagatgctgtcccccacccactgccaccacctcggtgcttctcccagccagacctccaactcagtctgctctcgctcactgccctctttgccgcctgsggatgcaggcaggaccctgctccctccctactggggctttctgtgccacttccagatttaacctggaccctgagaggaagtgctcagatagcacactgtgggaggccctggaaatcgcccagctgaagctggtggtgaaggcactgccaggaggcctcrgtaactactcctggctatgcagctgggttggttgggcactcaaggaccctgtaaggatggcagacagaagcccgtgtctcaggtttgccccaagtttggagtctgaagcctggcaggaccatttagtcctacttctcactatacgggggcccagagaggtcaggtgtcttgccccaggtcacacaactggtcagttcagggtctggctcctcctgcagggtacagcgggtacagtcagggatccttgtgagacagagattgcgagtcccccatgccaagggggcatcttcagccctgccctgccccatccacctgcatgcccagttctgccttaggggaggagaagatggactgggcaatcatagacacgggtcactcatcaaggccaccggtgattggcaaagccttggtatatttgctgcagctcctggagcattgggggtggccaagccttggtttcaatgaatcaccctaccaaggccctacatacacactcagtgcacccctcagtgcacacgccccctcccagaactgcccagggccacagcagcacacacctccaggggtgcccttctcgttgcagtccttgcagacggcctccacattgttgtgtcaggtgcaccagccctgcacacgcctgtgctcttggacacacacccacctatttgcccccatgcacacattttccaacagccccccaagccatcccatctgctccactcacagcacaagattaactcagtcctacttcatctccccgggctgttttcagatgccatcatcacagaaggcrgggagaatttcagccagggacagaggcagctgttctgcctgrccyrggccttcgtgaggaagaccagcatcttcatcatggacgaggccacggcttccattgacatggccacggttggtcctgggcccctccatgggaccatggtcttggaaagggtttagtgggatgctagggagaaatttgcacgaagtagtcctgaggctcaagttgcctctaacatcaaatgctatgtgttgcagaaaatgaaaagagctggggggaccctgactctgtctagtcttagggaatgttacacacacacacgcacacacaaaaacactatgcaaacacacacataagctgcacacacagacccacacagacttcacactgtcacctatcacaacagcacacacacagccacaaccacaacctacatacacacacagagctgagctcccaacaggctgagtccagtccctgagtgccgggaacctgttcagtcctgtggggtgggggtgggactaggatcggggtcagatgggagctgagccacagacctgggctccacatcccccaagccaggccagaccccatccactgggcaggtgagccaacagctgttgcccccacttggcaggaaaacatcctccaaaaggtggtgatgacagccttcgcagaccgcactgtggtcaccatcgcggtaaggggcccattgatggggtgcagagggacacccagggacaggactggcctsttgtggccgtcatcagtgcacagcccctgggcttgcctggtcccagkaatcaagaaagaaccctgaagcaggcagttcagggcaaggggcctggagggcatgcagggagcctgggttgcaggatttggggtgsggggttttgcccctgtgcttccctcagacctcccctctccttctccaggttccaaggcctgcccctgtcccaaggccttatatgttaggctggcgttacttctccataggaagtgggggaggggttgtggagggtctctgagccttgaagcctggaggtggggtagagttgggacttggagaggagagaagggtggtattagcagatggagagcttgtagtcacatccaccccaggaaagtgcagtccccacagtgacaggacattctggccacatgcctcatcctcctcctccaagccgcaggagggccaccctcagctgtggcccccaccgcgggtggtrttcccaccatcctgacccgccccctcctgccctgcccagcatcgagtgcacaccatccygagtgcagacctggtgatcgwcstgaagcggggtgccatccttgagttcgataagccagagaagctgctcagccggaaggacagcrtcttcgcctccttcgtccgtgcagacaagtgacctgccagagcccaagtgccatcccacattcggaccctgcccatacccctgcctgggttttctaactgtaaatcacttgtaaataaatagatttgattatttcctactagaggccctaagtctggtgggcaggggctggcggtggatggtgggttcagtagaaccagcctggctctgacatcaggcagaagctgtgtgagcaaaagcctgcttccttacctgtgaaatgaggcctctattagtcagccaggctgccacaacaacatatcacagactgggtggctttaaaacagacttttttctcacagttctggaggctgaagtctgggatcaaggtgttggcaggtttggtttctcctgaggcctctctccttggcttgcagagggctgccttctggctgtgtgctcacatgacctttactctgtgcacatgcatccctgctttctctctgtgtcttaaaaggacaccagtcatattggattagggccccacccctattacctcattaaaccttaattatctcytcacaggccctgtttccaaatacagttacattgtaggattaggcttcaacctgtgaatttggcaggayacaattatgtccatagcaagggtgatagcatttctgcaatgagcttatcagataaggtaacagatctccatacagcttggtctcctttcttctcactttcattcttgaattaaaatctggattaacactatttcaattgcaaatgacaggaacccaattcaaagtaacctaagcagaaactgaatttattgaatatgtgactgacaaggctaagaggtatactacttcaagcatggctggacccaggtgtttgacatccatctgggatgtgtcttcctttctgggttccattttcctccccttkcattatgacagatggccactagcaggtccagcttacatcctgccccaaggcaacccaagaggcaaaacagatrctccttcccaatagttccagcaaaagcttgggagcaaatctcaatgcaccaacttggatcacattcccatccccaccccactgtgatcagaggggtggcatacactggctggctaggcctggatcatgtstccatctccatccctcaagcaggggcattcagaagtggaaaggtggtccttcagagggaaagcacagtgcatgagtcacaggtcagccaggtggtgtctgggagacgctggagcccagacaccagggagactaaaacagcagctgtcctgacttcctctgcatcacgaaacaagagtgcacacctgcccttggccaagaaatggcaggtgctcatttacatctcattttatgatcatttgcatatcatctgcagtactggctgcaccaagccctgaggtgcagacctaagagtcttgaacctgcatcctcttggctgcaaggggatcatagaggcacaacataagaaaagcccaccagttatcggaggcaggtccagtgcagacccctgtggatgttccaggagccagagaagctcggaaaggaagagctctgtaaagcctggcagcctgcctggaaaagacaaaatttgagttaaayattgtgggggatagggattggttaggcagaaagtcagagaaagggttggggtggcaggtagggacagcaggagctaaggagtgatggtggaagtgtgttaagagtgttggttgatcagggaggtgggagagagattacagcagtggggagggcatcatatcagagagccctgaatgccagagcaaggagtttggtttatgcccatggacaaaaagggagaagggttttgagcaagaaagcgamttgacaagttcagtatttggtggagatgactataagcaagtgcaggatggagcaaaaggggaggctgagcctttcaggtgggagactcagcctctcagaagggtgagcagcagggagggaggtaaggcctcaaggctgcaccaggaggcagaacccagcctttccagctctgagatttccccaggggcccagcagcttcctccactgtgagatctcccaagagcagagccggggaactgaaagaggactccacaagcctaccactgctccaaagccaccccacctcaacagattgaagggaagtagcaggggcagggctgggcccacagtgaggtgttgcagggatgcccaaggtcatcctggcccaaaatccctgtataacatccctcatggcccaccgacttgatttgggtaccccacagatgtggctcatctctggttattgttattagaactgactcttgcatatgtgaaaccaaagcctgcctctgttccacttagtgtcctggttctaccctttgggccacaaaaaactactagtycatcctccttcaaggccaggtgtttctgcaatagtgcccaaatccctgggggactttccttttctgatggctggacagttgtagttgcctcagagatttccccatgtaaccctgtctccttgagcttcccactctgctcatctcattttaccctccccttcctagacactgcatctttgttaatatagcccatgatcacacccatcctttgtagcggtgttcgctctgcctgcaggtgggtagggagagaaaggaaaatccaatataaaatgcatatcttgcccccactgtggcccacagccacactgccttttccagaccctgtctcaagcccccactccaacaaaatggccrcagatggtcaggggttcttccataaggatctgagccacagacagcggtaaagccgttactgttccaacaacagagatctagcaggctttccctcccagctgagaacccgggtccatgccacagggcagcctcaggctgatgcctgaacagaaacaccaccatgccgggaccaagagcctgggtcccccagtgcccgaggcagccctaacacactgttcaggcctaaataccacccatgacctaacgtggaagaagtcaggtgacaggtgtgagaaagtgtaaagcaagtggcctcggctcaaaccttctttaaagtagggccggaatggctgagaagatggagccgcccaggctgccccacagcagtagcaggtgttaaactgtgctcctttcctgccgaggccttttttttttttttttttttttttttttttaatgagagggagtctgagcttccatcagattgtcaaaggattcaagactaagattaagagcatcccccaaagagaagcagctgcaggttgagaagtcctcggaccgcctaatttccgccagccctgggattggtggcgccgcctctcagcgcctcctttcccggggaacctgcaaacctggcgcggccgagaggcggattactgacccaaatacggatggggayattgggggaggggagccagggcgacagggcggcggccccagactgggagggcgggtcacagatccctcccagccccccactttcgtagagcgtgggcaggaggaacctctgggttccgcggatcagaaaaactccaaaggccgggttgtgagtcccgggaggggaggtggagggcgggggcggggaggggcgcgggaggggcgggggcttgctccggccccgccccctgcgctccggtgcaggtcgggctccccctggcggtccccggccccgttcctctcctcgtgcgcccccctcccgccgtcctagacccctgcctagcccaggtcggtctccgcggacccacggacggacagacagacgggaggacggccagccgcgagcgcccgggcggcgggagggggcggggaggcgacggccgtggcgtgaggagcaggagcaggtgcagcggcggcggcgggcggggccgggacccggcgcggagcgggagccgcggcgcgggcgggcggcagggaccgggaggccgcgactcggagtcagccccgccgggtcgcgcgcaggtccggggagccgcggttgagccgggtggggtggtgactccagagaacgcaggatcccaaggagacagagaggacgagagctggagggggatccggaaagcggcgggggcgctccgggaggggtggagtaggacatagggggcgcacctggaggagagacggggcgggggtggccaggacctgagctggagcctgggagcccgaaggccagacaggtgaggcgggagacccggaggtgggggtsaggtccggttagtgggagagatccggaggtgttaagttctgagctgggctgggaaggcaggctgggcggggagaarggctcttagcgggaggcccaggggtggtcagctggtgggggaagctgggggaggacgcagggccaggtggagagccggcagggttgggggctccctaggcgccaggcaggtgggctcaagggtgaggctgttttttttgttttgttttttgtttttgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagargtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatamgtgctgacacgcctggcagaggaccctgccragcccaggtaccgtgcccgccagcggagggcccgctttgtgtccaagaaaggcaactgcaacgtggcccacaagaacatccgggagcrgggccgcttcctgcaggacrkgttcaccacgctggtggacctcaagtggccacacacattgctcatcttcaccatgtccttcctgtgcagctggctgctcttcgccatggcctggyggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatccygatcctcatcgtgcagaacatcgtggggctcatgatcaacgccatcatgcttggctgcatcttcatgaagactgcccaagcccaccgcagggctgagaccctcatcttcagcaagcatgcggtgatcgcyctgcgccacggccrcctctgcttcatgctayrtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactstacgacstggcacccagcgacctgcaccaccaccaggacctcgagatcatmgtcatcctggaaggcgtggtggaaaccacgggcmtcaccacccaggcccgcacctcctacctggccgatgagatcctgtggggccagcgctttgtgcccattgtagctgaggaggacggacgttactctgtggactactccaagtttggcaacaccrtcaaagtgcccacaccactctgcacggcccgccagcttgatgaggaccacagcctactggaagctctgaccctcgcctcrgcccgcgggcccctgcgcaagcgcagcgtgcccatggccaaggccaagcccaagttcagcatctctccagattccctgtcctgagccatggtctctcgggccccccacacgcgtgtgta

SEQ ID NO: 13198 - DNA, 209822 bp, Homo sapiens
acatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctascccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtytccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttayctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgtyctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgawtttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgyggcaraagtagtttgtctttamtaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctytcacaggctggatgaagattggggtgagtgggatctgagaatgtaccagkgtggctcgggttygcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattcccrctggggaagtaccgggtgatctttttgtgtggctaacactggacgtctttaggaggtttagagcaaaatggctgggaccgccaaaaaggctacargctatttcctgagtgtgaaatgtgggcggtgagcacaatggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgycactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctccygagtcgctaggactacaggtgcacacygctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaayttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccatwattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtgtgcaggtttttgtgtggacatgcattttccaattgtttgggtraatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgrcatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgattcctggatcactctctttcacttttytttttttcttttagagrtggggtcttgttctcttgcccaggttggagctggagtatgcggtggagcaatcacagctcactgcatcytcagacccctggggtcaaaggatcctcctgcctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattyttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgtttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcstgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaaytgaaagaggggcaagggcagaagcagggagacgttttggaggctgttatagcaatccccrtgagttacaatagtagcagtggagtaatgagaagtagttggattatggatatgtacacacacacacacacacacacacacacacatacacacrtatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatyttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggktgccaaatggtaactatctaactctatcattctgtctatcattctatcattgttgattgacattgcactataagaaccaacctacctacctaccttccttccttccttygttccgtgatgaactcattgattccttttttatttggtggttggtaaaccgctactctcattttattctgatgctcagattttcccasatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcytgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtayatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaargaaaattactcagtgattcataaaagttttagaaatttaggaagtatagaacagtagraaaaraagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgdtrccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtataagattaacctgagaaccagacagggcttagggaatsaaagggaagagcctgggttaccagaacctargaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctaccyctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctttcctccatgttttccagttaaagatattaaggcagaaccycagccactttctccagcctcctcaagttattcagtctcrtctcctcggtcagtggrctcttattcttcaactcagcatgttcctgtgagtagccagtcttttacaatgattttgsttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcrcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtacsttgcaaataacttgttttttccttatgcatttcagagtaagttaccagtcygatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtgrtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattrtatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttatygctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagwcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaayagaaaagaatacaaataaaattattttgcttttgatattcttttaagaccaaataagagagattatggagaaaggatattggcattttaactgcaaccttatactgatactgaatgtttgtatgactacgaaccaagttttatrtgtgtgtgtgtgtgtgtgtgtctctgtgtgtgtgtgtgtgtststgtgtgtstgtgtgtgtgtgtgtgtgtagtttgtaggaagaaatgtagmaacrgatcaatgattcatatctttaacaggatggcatagacttactctgcattttgagttatttttcctttggtatagatggatcatgctgatagtcacttattacttaatatatakatacagtttctaatatacctttcctttgaagttaccytgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcascggagccactgaaggaagataagcctgtcactggtyctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagatatgggagtcatttccgtatggagatctcttaggtagwttagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaayttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgtyatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatrtgtttctaatttttatttgcgtatttggcctaagcatrtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattagraaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacamaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtcytttttttttttttttttttttygkcctttttagggatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtatattgttaatgataactcaaagagatgaatttagttggtcacattwaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgytgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacrttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaagrtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgwcatyttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgygccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatrgctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtrtatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaactyatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactrctttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagawtactattttataactatgtgaaagaatattaattgttagcaggagagatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatmcatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtraggaacagacagagtgctcagaggaatgttaagttttaggctctttttctgcttctttagtgattaaataacatttcatgctttgtgtgtgtgtgtgtgtgtgtgttttaattttaaaacttaaaatctgaaaatgggagctggaatgggagcaggtattttcytttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctyggcctcccaaagtgctgggatcacaggcgtgagccaccgcgcccggccaggagcaggtattttcaatwttgctttagttgcatggtatatcagagcagctgtgaggtacattgttgatggaagtaataattttgcctccyctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggarctggttatatgcatacatacacacaaaacttaatagaaagagtaaaataaaattttgactgtcatgagattgagaagagtagagatagtgaaagtctaaattttctctttttttctgctttaaacaatttaatgagaaaaataartgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgwaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaartggccttataattaattgaatatatggttctggggcatagccatttaagggccagagatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatasggctgagtcgagatgggctaaagtatyctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagaygyagaaagctgaatttggcaattatcaggtcagttgtaatcttggaaagcagatttagtaggggtaggcatgaagtctgtattaaaattggttgagaaattgaaaggagttaaaattgaatratctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtrtgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacytcattagcataaactcaggtccagctggaaggggcttattayggataacaaaagatgctcttcttaccccctatcactcaggaaattccaagggttttaggagctctgtgacagraaccagaataaaaaccaaatatattatttcttattatatcgcaaattcacaggcatattcttgagggaacataraagtaaccagtaacgctgctagtggcaatcatgggaggctttatgcagtagtactcgatgaaggaataaagaggattagattatgctacaggaagtgacrgtggggttaggggggacatctcattgtggaagccctcatgaatcaatagaattttaggaaagaaaagactggaacaaaaaaaattttttgagtgcccccrcccaccagacaaaaawtttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgyggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaaytggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggarcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatcyagcaacatatcaaaaagcttatccaccatgatcaagtgggcttcatccctgggatgcaaggctggttcaacatacacaaatcaataaatgtaatccagcatataaacagaaccaaagacaaaaaccacatrrttatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcstgraaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctasaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccrtcagagtgaacaggcaacctacagaatgggagaaaatttttgyaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacrccaggaaaccataccaccatgaataagagttagaaaaaataaactacagaatcacactctgaaagastatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactacmaccctaatactgtgctcttccaacgggcttaacaaacagcacacgaggagattatatccagcacctgacttggagggtcctayrcccacagagcctcgctcattgctagcacagcagtctgagatcaaactgcaaggcggcagcraggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgrgggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctygaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacktattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattytatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacrtaatttcagctttttgtgtgtggctctccaagycacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatattgtcatyacaatgtgataatcattaccaaagtgggcactkggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgarttaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctggggtaagggggatgttagatgtctttggacattasaagaaggcttacttagacttgttctggatagccacagaatccagaactagtatcaaaaggtggaagtttttttgttttttkktttttaaaaaggaagcacatttctagttaaaacaaggggaaactcttaataattagggtggtagagatactggagggatcagggagtgagtacttccaccaaacaggaacattagtatatggatatttcactaatamcaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcaggtaaacctttagtctgaatgatacagctrtgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagyctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatrtgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtmcttgacwaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacrtgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcrttttatgtctcaccctatccttaacatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagayatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagrttttttgtgatatgtagtaatcaactacagttaaacatagtttaacatcttcacagctgctgtaaaaagtaagcaaaataagggaagttatatatgagctatgcttttatttcgtgtgktgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattayaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatycatttctatgtttaattaatttctatgtttaattaattaaactatattttawaggttaaatcatgaacttcgaggatgggttcatagacatgaagtagaaaggaccaagtcwagaagaatgacaaataatcaacagaaaacccgtattcttcaggtatgttyctgtttgtctttgaacaatagttggcgtatttgttggaaggcttctcccagctgggttactctcttccctagaagkttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacmtggggcagtttggaaatgaagacatccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacmctgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcragaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacrcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcrtgaaagttctttcattggagtggtgatggcaaaagccaactgaagtggattcagggaagtaataatagagggggaagtgaagaaaattatttcagggtgatccctayacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatrctttttttttggccttatcattagatggaacttgtcatgtttttctttcctagtcattaaatgaatagagcatttactgtgraaggggtgcttggtattctttawtcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccrgttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttwaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatrtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcayggtacataagtgccccccaaaatggtaaatgrtaatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcrtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaawtaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttrcaaaataktgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtgraacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcakgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggygggagaatggcgtgaacctgggagrcggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctrtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtarccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatgrtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaamgattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttsactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtcmgctgtagaaatgaaaaaacaaatttatccattgtgacatcrtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaaygaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatrtgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcataygtctgaaacaagagaaagatggctttcaatgtatggtyattttttattaacaattttgacyagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagwtctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatktgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcaratgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacmgctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttygaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcycttgtgtaaatacctaggagtgggatggctgggttatatagtaggcatatgtttagctttttaagaaactaccaaactactttggtacaagtggttgtaccattttacattcccaccagtgggaataagagttgcagtgcctccayatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagwtaatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatakaatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttmctgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacrttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattrgattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactastatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctrtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcvtaaagtgctgggattacaggcttgagccactgcactcggcctgaagcattttatgatgctcactaccragtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaacygtatataccattgaagatgttttgggtataaaagggaatttccataataattacatagtaatcttttakagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatrtcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacayagaaaccatctttgattttcaactcctaattgrgactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttsacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttagraagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgcygccttgccattgacaggtcttcacaatgctttcttaaacgacattctttggaactgtctttcatagtcaggcgacccgccagccaggccgccaggtaggtggaagggcggcttcgggaactagatccggctsgttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacragggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtartgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctrtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttartacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttcyttctttctttctttttttttgagatggagtttcgctcttgttgaccaggctggagtgcagtggtgcgatctcgactcactgcagcctccacctcccaggttcaagggattctcctgcctcagcctcccaagtwgctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataatraacttaggaactggtgttacaatayggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttrtgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttrttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgkatttttagcagagacggggtttcaccatctcagccaggctgaccgggaactcttgacctcgtgarccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatakaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaarttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatrtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccartgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacattkgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttrtttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcrtatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtrcatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaargtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccrcccttctttatctacctcttttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgattctgatatgtatctttygttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcartaaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtarcacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttytgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttrtgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgrtgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacratttaattggagggaaaraaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcrcagaggctcacacctgtaatcccagcactttgggaggccgaggygggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttytgaagccaagcttctcttggsttattcttacttttagtacttgtgtgctggaaattagaaacytcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcraaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctccygagcasctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccragtagctgggactacaggygcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctctttttttttttttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcaygatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtrtctcttgtaacggaataccaagtaattmttgactgatgaatttcattttctttcctttttgttagatactaccagcsccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttwttttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttttcattaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcarggatrtgcctccacattcactcacgcagcaggtggcctctttctggggctgctcacaacatggcttccccaaagcaactgttccgtaagagtgagaaagcaagtgagtaagagcactcccaagatggaagccactgtcttttaracttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcrgctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttrtaaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatygttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagycttaatgccgtcytcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaayaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcrtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccayttttgatccatctgccaatcctattaactttaccttcaaaatggactccaaatccaaccacttctcatcagatctrtcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgyaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggstatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccrctcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttytttttttcggcggggtgggggggttttgtttgtttgttttttgcactaagtcataraactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaarcattaactcctcagccctcataccatcacaggaaaacarcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactrcaacctccrcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatctggtcttgtgaactrttactagtatttttcttccatatgtattttacctaccaacttgattgtaaactgcttaaagatagaagctatgttatataakcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaatyctctttgatttaccttggkgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccatyaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttcygttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaacygcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttcyataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattgrtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggyggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaaygcagattagtgaacgtggattcctgctgagggagtgcatcccataatatggcaataattttcagtttctccaacgaaaagatagtgaaggaattaaatcttttgtcctcccatggttaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactcccyttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggractgtcatacgttatcatggtcaatgtaaacctggtttgtgtggggtgattataaatagagtttccctcctctctgtgacagaatcacaggagaaggacccatctcgtggccttcttgttcttagcgcttcacttttacttcrtccctcgattcccagctttttctatcatcattttrccaactcctcagatgcaagactttggttatgtcatactcaccaacrttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaratgaggggacaggattctcctaagggtagagtttcaggaaatgagtgaaaggcaattgacaaatgcaaagaagtagtcactttttaaattgcyggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttkgggctgacaataatacactcttgrgaagtgatggtagagactgatgggaatagtctttctgcctggttgcaagtcccaaatttttaaggsttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaartctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcragatgctggtgagactgycgtggtggcatttagcatcgttaaaactggaaaactctcaagctctttgccactttcctactattttttgattcttgccattttaccaagcttaggttgtgaaacttgacagaaatgtattacaggaaaarcttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcrgccatttgttctaatatstgtgttattagatgcaatagaatttatgaaaagaagaatgacaaaggtatctgattasaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaacttaccttgtttattctgtatgtagaaagagagaaaaaarcccccaaatgaatcttcagtgttggggggttagtaatgggaaaggaagcctgaaaaggctttgtggcttgtgttactgttcagatgaaactgttgaactattttccactcttctcccaagcctaattaagtaaaaatttcctttatttaagtgtccagatatttaaactacaatcttatcaaggaaaaaaaaatctaaaaacccatattttatctatgtcttcaggaaagtgggttactcggtcacgcatcttgtcctcaccaaaggcctcttcccagcttgcaatggcaaatgccaccacacctgaagctagtcactgcagactgacagcaagggatccatccaggagtaattaatgcaggcatttactgagcacccaatgattacctctgacactggtttattaactatattatcttatttcaatcgtctctacatcctattttgtaagatggttattaataagtagtggagctggctgggtgcagtggctcacgcctgtaatcctagcactctgggaggccaaggcaggtggatcacctgagctcaggagtttgagaccagcctaagcaaaatggtgaaaccctgtctctacaaaaaatacaaaaattagccaggcatggtggcaggtgcctgtaatcccagctacaagctacatggggagctgaagtgggaggatcacttgaacccaggaggcggaggttgcaatgagccaagatcacatcactgcactcctgcctgggtgacagagtgagaccctgtctcaaaaataaaaattaaaaaatagtggcccaatatttgggcccaggcaattatgtgaattattcaccattatattattccacctgctgatacatagatctggcataagttcatgccctaaaagagctcacagtcagcccatggagccatatacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagatyggagggtagagggttgaacagcagaaaagagaaatgggaccaaggaatagggctggagactaaagcccccraggggagtgtcatgaaaagaccccctggtggcaggagggcaaaggacttttacaaactgtgatgctgaaatgcaaatcctcttcattgccccaactcttcagtaaaagcagatacacagttttgtatcaatgttgccttgggagtgagagactgaaggtaggactcaacatgatattactagtgaagaagaagacagcacagcaagataattcatacactgaagtgtcagtggacgtcaggtgaaacagggaaataaaaacttccaaccccccaccccgcccccacaatctttatggcattgtcccctgsgacttctcactctatgtgggatatggttcaagccaatttttgaatctcaaagggtaaccacaaatgacatttgggttatataatacatggtatcatagatagagggcctctttagcatttaccctgtaatttacctaactggtccaattttggtagagatttaaatcacttccaatgttttgctcaccatrggaaacctatcgcatatttcactccgtcgtattcattcggcatgatctgtrcaaatgcctgaagagaatcgttctcttagttcagttcagagtaggagctgatgcttattgaggacttaaccttccagacatcatgctaagcctttacaagcattagctcatttgaactttgcagcaagccttcatcatcgacataataatacctatgtctgtgaattacagatgaagaaatagtcacaagagattaagtaacttgcccaggatctcacaactagtacatagcagagttgagatttgaaatkaagtctgtcatgattttaaagccacattccttctactatgctacattgtcattcatcctttgaagtcataaagagacaaatgagtgaggaagaaaccaagccacacaacacaggcaaccagggtattgaggcatgttcaggaaagagggagagtcgctaagaggcraggtccagcagtactcgagggttttctatgagtgactcagaaggcatacactcgatgctggctgcatgcagagcccatgctgggctgctgcaccaattctkctagacctcagtccttgtagtccccatcttggacgagttacccagtggggtggatacaagctggctcctccataattgaagatcctaggctctcctaactctcctactctactcatatccaaaagcccacccaagtgtggcatccagctccatcccaggatgtatccactgttttccctgtgatcacaagttctatagaaagttttcactgcagaattaactgctgatgtggatgctggactatgaaatagagatgcttgtgtaagagatcactaatctgcagacccaaaattgaaatggtttgtttcagaagtgaaggatatatctttaaaataaatacaacacaccatattaataaatggatcatcttgtaagattgagtgcagcagtgtcagtcctaaaagctgtatccatttggaaggcggaccttgcaaggctaacagaaaatactgttgccaattgtttacagtacagcccatatttctgcaaacatcaactgggtacaaaggaagaactgagaacctcaaaagccatctcagatgctccttccctaggtgtcctgcttgacttctgaagcctccgagttatctccatttcctgagcacccaatggagcttcgattcttgggctgcatttcttcatagtgggctagaggcaatggccctgraatttaaacatttgccactagttctaagtgttgtgcgaagctccaacatctaccayggagctgtaggaaaccatacagatgaactagacaacatccttgacatgtcctttacatgtctagacacatgagttatgtctcttccatgggactatgtggtcacccttctgtccccacagaagagtaaagatcatttccaggtgaggrtaagatttctggtcagcctgaaaaagaaagttcagttggacacaagctactctcaggagagtttgggggtgggaggttcatggccagcatctttgccatgggcacagatctcacccactcacttggctgctggccccaggacatcaaatgatccatttcgccatattgtctctggtttcctggagttgctggaattcttctctgctaagccattcgttcacatgagatcgacatgttgtccccttccgcctggcaacctttaggaagacggaattacagcaacccccacacatccaactaggctgtctccatcaaatcaccagctagggggaacaggaaattcgtcttaatttagacaatatgagcaggaaagatgctgaaacacttaatctcttgttttaaatgactctacaggtcaccacccaggggagcacaactagaagcacattgcaagtagcagcacggttggggccgattccatcttcccaggatttrtcatctggtacaaggcagcagggctcaaayagtccaaggaaggaaaaggccactcatagaaagattgtttttgttgccatagcagcatcttgtacttatcccttcctaactcccatcgcctttgcaattaccaggtmaacatttatcatccctgtgggacagtgagctccagaagagcaggaaccctactaatgtcttgaattcgatttttttcctccaaaagtgctgtggatatagtgtgcttgggacatggtggtttgggcattttaggctaaatcaggatttcrttgaattattgagcatttagaaagccacaaatatacactgtccttccaggagtctgcatgatagactggcatttgtcacactgcactagctaccgcaccctattcagatattcacagrgcacagaagttgcagtatgtgcgatgcccagtgctgaggcaggactgcaagggaaaacagcagagatccctgccttcccttaaaagatgaggcatcatttgttttcctcttccccttttcttttcttttttttttttttttgagatgaggtctcgctctgttgcccaggctggagtgcagtggcgcsatctcggctcactgcaagctctgcgtctggggttcayrccattctcctgcctcagcctcccaagcagctgggactacaggcgcccgccaccacgccctgctaattttttgtatttttagtagcaacggggtttcaccatgttagccaagatggtctcgatctcctgacctcatgatccatccgccttggcctcccaaagtgctgggattacaggtgtgagccaccgggcccrgccttccccttttcttttcatcctattgctttttcctctggcttcagtctgtggcatattagaaatgggcctggaaagaggatgtaaaccagcgagtctgcaagyggggccctgagactgcagcagcacctcaaaacttgttagaaatgcaactttwctggtcccaacccagacccattgagtcagactccaaggcygggcctagcaccctgtgtttcaacaagttccccagatgactctgagaggggactgagaaacacccgtgtagttccctgtcagcaagactggagaatgggaagatgcagactcctgccagagatgaaccttcccctggctgctgatgttggggtgggtggtaatatcaggatcacctgatgtcaggagttcaagaccagcctggccaacatggtggaaccccgtctctactaaaatactaaaattagccaggcttggtggtgcgcgcctgtaatcccagccacttggtaggctgaggcaagagaattgcttgagcctgggaggcggaggttgcagtgagtggagatcgtgccactgcactccagcctgggcgacagagctagccagamtctgtctccattaaaagaaaaaaaaagcaaagaaagaaaaagaaagaattgtgtgtgtgtgctgcatttttggaagtccacaggggttacatcttcagcatccacagcctccatccctgctgctgccaccctgggtggctgcactcccagctgagaggcctgaatcaggcctgtggatatagtgtgcttgggacatggtggtttgggcattttaggtgaaatccaggttttgttgaattattgagcatttagaaagccacaaatatacactgtccttccaggaatgtgcatgatagactggcatttgtcacactgcactagctaccrcaccctatgsaaaaagaaaaagaaaaaaagaattgattaaggaatcagatgcatgcactcagccaagtcagccaccatccaggctcgggggatgcatccaggacgagaggcggaaccggctgcttgctccccaacaggtccacagctctcctgggcactgaactcctgggagcccctgcttcgaaccagcaccctttgctgtgggagggggccgtcagcctccctggagcaggtcttcactaggtggctgggagaacccccagcgctgggcaggggcaccccagagagaatgctcgtggcccctccttcgcagctctgaaggcaaggtgtgtgccccaggctccatgggcagagttggctaaaggctggaatccccttcacttcagccctagcttggtggttctcaaactttgctgcactttggaaccacctggggacctttaacaaatactggtgcgtggctcccacccccagacattctgactgaattggtagagggtgtgacctgggcataggagtgtgaacatttccccaggtgattctaatgtgcagaaaagcttgggaaccaatggacgctgtcttttgaggtctagttctgatgtttatggagcaacaccatcctagaggttgagggtgg

SEQ ID NO: 13199 - DNA, 151870 bp, Homo sapiens
  misc_feature (1)...(151870): n = A,T,C or G, or insertion/deletion polymorphism (see Tables 1-2)
agatgtttggtgttttagtaaagacagacttcaaactaagtggtgactaagcaaaccccttacataaagctttgaataggatttcataaatattccaatgaaaaacatttggagataagaaggaaaaaaagctcacacttatgaaaaaattattttcagaaaaccacttaaaattcaaattaagtcctattcatttaaatattaaaatataccataaacccaaatttaaaggaatgataatacatacatcagctttcaatggtagctgcttatttaaaatgagcatctgagggtatattccagtttcatcctcttcaaattgtgcagctcagataaatgtttattttatggaaaatatttgcaaaattacaatataaatacatgattatattaaggtaggatgactatataatttattcttatctatagatataaaatgaactcagtaaatatagcacactcttgatgaattgttagtacacagtgtttctcagtaaagtattattaagcaacagttatctagttttcaaatgtacatcttaagaagcttttaagatggaaggatvcactaaatcccccaataccctttttagttggggaaggttagtacttctgtgaattctgagatatcatatttgtgttagtgactgttcataggttccttgcatttccttaacttgaaaccttacttctttagtctgaatgttctttaaataatgccacatcagctaaccacacttttaatttgagtataatattatgtactgcatatttattcattacttaaacacatatcaacaatgaaacaatgattgaaaaaaattttgtctagacaaattccccaaattaactgtcagggcactgtggggaatctcaactaaatatagtctcaactgtaataagaatttgggttagaaatagtattttatttattctagttcttaagacatcaaatgtgaactctactttaaaattctttgttaaatatactgggatttgtttcaaaagcatcttctacccttctccattacactgatttaatggaaacctgttacaacaacagttccaacacaaacatatgcatgcacgggatcaccttatagattctagctacatagttattgaaacacatcccacctgtcaagtggcataaatgtacatcttctatatacaaaaggtaaagtgcattattaaattagtgaactgacagattgtctgcctggaccatacagctttcaaatagacaaatgtgaaattctcatattagaaccaattatttcaagaggttccaactagcttttccaccctgtcatttatttttttggccatgctctttagtgcaaataagcttgtgtttgactcaagtttcagggacatggcagtctggggctttaacaaggaaaattataaaatgtagaggaactttaatatctttataatacattgcatcttttgcataaagcaacagattagtgctgctttcgattgctaggagcacactgccaactatcaagaggaacccgtttccaaatttcatactattagcttatattactacagtttgagcctgtaccacattatgcttggattattaggtgcaaacatcatcagtgttttagaattatacagtgaactagtacttttggttactaactttcatgctcattttttaacttctaacttccagttgccttaagagtttaatgtcttcaaggcagggattctgttattttgaaggataccatgaacacttgcagctccatgtatgttacaaatgacaataaataaaatgcatattgcacagataagaatagtagcttattttataagatacatggcaatacatgtcctaagaccagagttttgaactggatcatatttaattacggctaatgaattcttgggaattttaagtatcaaaaagtcatagcatcatctcatttttgaatgattaactatgaaaaaaatgaaacaaaaggactggcagaaggcttaataattttagagtatactcaattgccagtatatatgcatctatttaatctgcagctttgagatggtaaaaactttgaagtatacatmcaaagtagaaaatctggctgcttaactaattctttacttaaataattaatggaaaactaaatttaataatgtttatatacaatgagttaaagatatttatctttaagtctgacatggtattgtatgtatgtatacacacatatatatgtatacatgtatatacatatgtctgtgtgtatatatatagatatagacacatacccaaatcttatcagacccaaaaggtaaaaggaaatcatttagacctaatggatataaatattttagaaaggaagactttaagagagtgtatacactcatagcaatagcgataggaacaatcaaatactagaatattcacagctccagtttgccaaaatctgacaggttgattattattaataggcactatgatgggcagcaataacaatcagtagtacagtaattcaagtgcacatcattccttcatagaccaaaaactacttttttagcaagcctacatagttattttacagttaggactgtttaaaaatccttgctacttttagagtctcaacacccaccatgtgctattagctctagtactaacattatctcctaaccttcagttgttccatagtgatccagatggtccacaattataatgaactaatgagattccttcacgctactagaggaaatgtgaaatacaatctgcaaaccaacactagtatatatgtcggggttactgattgcttgttcttaagtaacmtaaaccaatgaaattaatttttttaattcataccatcaagttttcttagtgacctcacgtaaaggtattgggggacaaaactctggaagaaaaaaatcgctgatataattttaaattacttttagcatataaaagaagagctacattctgatttgaatccatgcagccagctctcatcaatgagagtgatatttgggggttraaatcagtgttctggctcttaaatatgattagatggacttattgtgtgggaggtgaataaagccaagataaaagacaataatttcattcagaagaaaatatagctgaatagatgtaatttcagtcaattaatacaggatgggttggtacacatataacactatatccacttrtttaaaaaattgcttaggtgttgaaaaattgctgtggcacttcctggaaagtaatttttaatacaggtaaatgggtgagtcttgtgtaaagtcagaaagagcaccttggaaaatgcctgaattttcctttcaaatatatttataaccaatcttcaaataatatttttctcagactggaaatttgtattctaaattatttttagaaaaaaaaaatccccaccccctccagaattaaaacacctgtaaaatwcaggattatattggaagtgttgacatggttttaagggtagcaattgcaaaagtgctactaaaatatattattacaggtatatttttatatcagttaattggtacaccaacccttctgaaagagtgttaaagaagaagcataaagtataacaccttgagtccatgatatattttggggaagaaacctcttgcaatctttaaattagcatgaaaagctacaccaccaagatttccatagcaaagccattggatgaagcctcccactcaatgtgacataaaagtaattcctgaaactttggaaagtcaataaaaatatatggaacattaagtagaggtaaagaagggattgtaactaaacttagaataacgaattaaaactctcccatggctttgatatggcaactataaaatgtagggttaccacaaagtttgaaattatagaatactatagtattcttaagaaatattatgacattatatttttaaggtttaattaggtaataagatttgatcctttgatggtatattcagttattcaacggacaatatacgtctacttgtacttttataagtaaatatttatatataccggaggtcaatttctgtttctgtggtaactgccctacaggtaagcttagcagcttttaatgaagtagaattgaaatacttttgggggaaagtcacacttctatttaagtatatgtatcttttttcgggattatgtcatagtgcaatgtaaatcttagttatggtatttagaatgtcagaatgtcacattttgtgctgatttgcatacttcaatagtctggagcagttgaagcagctaaactatttagctctgggaaggttggaattcccgtaagaattatagtgatctatgtgtaacataacatgagaatcagacttcctgaagtatcaactactagaggtattactaataacaacgggccaaaaaagaggaaaaacttcttcaaaggataatggatcagtacttttagccaatttgtgattttaaattttgcctgatggagttcaatttcactctagtcgaggcattcttgttcttcaccactggcctttctgccatccattctcttttctttatggctgttgcaaattttcctcatctcttcttcatacttgataaaattctccccaaaccttgtccaagctttgaatggaacagtaatagtattacggtaaggtggtctcacctcacttaccttcaggaaaattccatatttattagagcccacatcaaagtagaaccttttattgtccactctgaaagaagtcccctctgggagttcaagcggrtcatcgtctccacctcttcgttcttctatgtctccttcgccatagtctkcaatcagctgaaccaaggcatcacgaaactcaatcattccttgtgctgggaggacaatagtctgttcttggcccaaactgtggccaaaataacctatcatgccagtcccccgcatcatggtttgtctaatccgtaggaagcgaccccgctgattttcctttaggtctaggtaatatttcctattgtccctctckatatagtctgttttcaggacactgtgaggatgctcttcggaccccaccgagactggtggggagggtgccgagtgcttctgcctccttctggagccttgctytttgctgtggccatgctcttgccggtggcctttcaggcccaggtgggcatagtgctcgatgaagtcccctagacagtccttcagctccgctgccacagacagggagagggtcagtttactctttctgatgttgtcctgccggcctctccctatccagacttcggctatctttaggaagcggccccgggagctttgcttcacgtcyaggtaaaacctctttttctggatgtccactcgtttggaggccagctcctggatttcggctgcgcccccggcctgattaggggtggctgaggccgcgtagtgggggtagtgggagtgctgggcctggggatagagtctactcttgcytaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccrgctcccccggcgccgcagcgcggggctccagccactgccggccggttggcggccgccgctccggctctgcccgcgctccccgcatccctccgccgcccccggggccgctcccgcacgccgccgccgcccgtcccgcgctccgcggccccaggtctccagccggcgggcactcacatcatctctgccatcaccgccgccgccgatgcccttcacgaccaccgccgccgccaccgccagctctcggcccctctgctgcagccgccgcagccgccgccccccgcctccycccccgccgccgccgctcgcactgccccccgccggagcagccgggcaggggcatcgcccgcggcgcccaccgcagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagasggggtctccgctsttcctcagtgcamtctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctcyacgcatgcgcaccgcggcgcgctgggcggggctggatgggctgtggtgggagggttgcagcgccgcgagaaaggcgagccgggccgggggcggggaaaggggtggggcaggaacgggggcggggacggcsctggaggggcgggtcgggtaggtctcccggagctgatgtgtactgtgtgcgccggggaggcgccrgcttgtactcggcagygcgggaataaagtttgctgatttggtgtctagcstggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcmgaaagtgtttccccgcccctgacggccccagcttgatgtttaccttgcgcgcttagttaggattgctctttctagtacggcctttattatggcagaaattgagccactacaggtctgcacagcaaagtcgagggaartaacctgctgtctatgatttagcaagtgatgrtggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggwgggatattgggataagtaggacagttcagatcttgatgtcattgaatagtggtgtctacctaaaaggaagaggctggggcacaaaattataatttaaagtgtttacttcagccaaaatgaggamagctgcccrggactcatttcccagttgccttggggagtgctccttcagccttggttacaagcaggtttttaaaggcgaagggraagagtgggctgagacaaagttggtcaggaattgttattggtttacagagatacsattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatrcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaraaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattytaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctrtaaagaaaaatgaagcttcgcttgcttgcctgctgctcacctactgctttgtggcctggttcctaacaggccatggactggtamtaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagakaattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcrtcatacctaattcccaaatccaakgccatgaagattttctgttatgttttcttttaatagttttatagttttactttttctattggagttttaagtaaattcttgtatattagtgtgatacattttaagttatttttgtatatggtgtgaggtaggggtccaacttcactsttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacamtgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagwagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgytattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttygagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatwcccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagatkagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcarcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccrtaccagaggagagtcccgaaatttgttgcaattggactgccttggaagcaataattatggccaggagatggaggctagagaactgagacctgatcatagctcctatccttgaatcagttgtatagcarggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagckccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcytgactacgtgatccgcctgcctcggcctcccaaagttctgggattataggcgtgagccactgtgcccggccaatttcattttctattttgaaatttaaactaccactgacacttcgttttccctctgttttacttagcatttatcttaragaataatcttaatatgkatagktctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaaratttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccrctacrtccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaayggatgctagcaaggcaaccgttaacatccacttactgatgartcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcwtgtgtgtgtataaatgtataaattagttactagtatatacgtaagtataaaamctcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaaygaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgaytttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttrgaggttttatgaacaaagaaatctctgagttcatccaccaaaacccaactttctcttgagactggcctcttgagactggtgttaaatttgtctattttctagaagatgacrctattctaagtggaaaatacggttctcttgaggtgaatttctactctatcaagagtgaagtagagtatggcttaaaagttaagtgattaaaaagctaccctttcttagctaatttgkaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccaraccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcasctttaggtgaagaaatgcggtgagctattttrttactgattatgtggacmgwccaaaggaaggttcataagcgaaaaggaaaaatttaaattattccatgtgagygattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatrcatgttttttaaaaacattaattttattttaagttccaggatacatgtgcaggacgtgcaggtttgctacataggtaaatgtgtgccatggtggtttgctgcacctatcaatctgtcacctacatattaagccccgyatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgstgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacmttcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcascaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggcygggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagcsgggcttggtggcgggcgcctgtagtcccagctactcaggaggctgaggcaggagaatggcatgaacccaggaggcagatcttgcagagagctgagatcgtgccactgcactccagcctgggcracacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctkttttttttttttaaatgcacacaccacgtttgagagattcttattcactgtattttctttaattatacttgaattttggtttacattgaggagtgccctcraagatattaacagatttttaaraaatcctctaaaaaactcattcttagggaaatttgttcacttactaggtraggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggwttttcattgatagtraggtaaggttattcttgagaaagactcaaagtcataaaataatagamtttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgtttttyggactctgcaaataggacatttcaaagatgagtgaaaaaaaattggaaacaactgcacagcagcggaartgtcctgaatggatgaatgtgcagaataaaagatgtgctgtagaagaaagaarggtatgttgytcattgactattctttygggtgagaaatttaatttatatttgactgygcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaraaactcaggaaaataaatgcytttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcrgaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcartagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaamattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatccyrgctaacatggtgaaacaccrtctctactaaaaatacaaaaaattagccaggtgtggtggcgtgygcctgtagtctcagctactcaggaggctgaagcaggagaatcgcttgaacctgggaggcagaggttgcggtgagccaagattgcatcactgcactccagcstgggygacagagtgaggctcygtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacraaaggcagagrtaggttaagctrtttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctrtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaattttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttasccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttgkcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttytttttctttttaataaaaayrgggtcttgctctgttatccaggctggagtgcggtggcgagatcatactcaatgcagcctcaacctyatgggctcgagtgatcctttcgcctcarcctctcaagtagctacaactactggtgtgtgctgccatgcctggctaattttttatttatagtttttaaagacagggtctcactatgttgcccaggctagttttgaactcctggcttctagtgatcctcytgccttggtctcttacttaaagcactgggattacaggtgtgagccactggctgctcacatgttttttatartagtacttaataattttatgtctgaaaatattatataatgttattttgcccatttaaaaactttaaaaaatgctaacaaactgtgtactctgtaacttgwcttttttactcaacactaygtttttgagaatttttcttgttgatctgtgtagttccattttaactgttatatcttaytatgtttcattatgcaacagttggttcaatccattctcttgttaatggaaatttmgtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtygttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtgrttgccttttaatttttgaattatgtctttagttatgyrgaagtttaaaattttarcataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacrtttcttccatgtcaggttggtatctctacatttcwtttttatatggctgataattgtaatatgtcaactttatccctataaaattaagttcttttattagctggcygttctctcattatctcaaatttatttaagtatttatgttctacctgattcactcacattccttgttttatttaattttcacaacrtacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttayacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagmttattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggkggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcartcttggctcactgaaacctctgcctcctgggttcaagygattctcctgcctcagcctcccgagtagctggcactacaggcgtgccaccacacccagctaattttttgtattttttttagtagagacgaggtttcaccgtgttagccaggatggtcttgatctyctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttytttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacartgtgractgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgyacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgmttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactccttkgaattgtaaycagcaaacaattcayttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatacttttwaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcayatatttgcaaagcatttagtactataacttcttgaatgtctgagcrgtcctgrcattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagrttatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatamtgatktacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctygtagcttccttttggagwttttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaargattagaacataaaaggatatttacacattgtttccccattgacttattcccaagatggtagctaataaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttaygtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttggraggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagawgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcakcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagaygtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgccyggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaastcactggcastgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatytggaagttgatcactgattagaaaggcttacattttattttggccgggggtggcagctcatgcctgtaatcccagcactttgggaggccaaggtgggcggatcccttaggccagaagttggagaccagcctggccaccrttgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaawggaagggcttacattttattttggwgctgactgggaatgaaggcaatgagggatgactgttggagaaggctgtgcttactaaacagtattattaagtagcagcatacatggtgttatactgacttctgattttgcaatagtacagacrggttcagattctcatttccaccttctccttcygcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatyacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtrrwtctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagkgcagtgacatgatctcaggtcactgcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacattttyccctccatgaaattaragcagccaccttttacatgacttttacatgcatttcaratttttgtactarcaattaaaatatctactggatgtaaatcacatgtgcttaatgctttgcttcataatatctgttgaagtcaattaaaatataragacagatctttaaattgaacatgttttatttgggaagcaagaattaaatttgaggcatawacacagactgggtgtccttggtatctctgaagaacaaagrgaaktttggaggttatagaaaaaggaaaatgtgacattgtttttccagaaagttctttggcactagtaaattttggggagttggaagctctgatgggttagtgactgtggtgggtaaaactagtcttagartcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagcckttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagrtaacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctcttkggagttctgcatagtgtttcttgtttaaaccacacctataatgtaccatctacaatttccaattctttaagacagagtgaaaaattaagacacctgaagcaatctgagtgcggartcctaggcattatgattttccttgacacttttagggttcttttatcacagtttatcaaacaccttttttttttttaacaaaaaacaaatttacaaaatctttccatgtattcaacttagaatttaatgaaatagggtttttttttttttggtggtcatgtatcatcarctttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcascttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcarctactgggggagtacaacagaaacaaattagagaacatgaagttttaattcacgttraagatgaaacatgggacccaacacttgatcatttagctaaacatgatggagaagatgtacttggaaataaagtggaaygaaaagaagatggatttgaagatggagtagaagacaacaaattgaaagaraatatrgaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctasaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgastttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagrtggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatrcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctcccyggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccattttttwattgggtactaattattagtattgctttctttattygttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcartagactgaataaataacatctctgacaytatttttcaattatatagagaatgctwtttgtaaaatactgatttatttaaagatattacartcatagtagttttttgcaatctttttwaaatcagtggatgtcaagraacaactattgttctttgtacrgcatttttcaacattgtgaagagttcttatactcaaaaagtttgggagacacagtktgayattgtttaacctgagttgaacttgtcatttygtattcttgtttagagcagggattttattttgtctctttatctaactttgtattcctaactatttctttctttctctttggttctttgtttctttgttcattcttctctctctcccttttttatctatcatataaatatgtaaatatatattatatatccattagggaagaggaagytgtctaaagatatctagtatataggagctttgttctgyagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaayattacttcaagttctttccaaaggacatttaattaagtaaaatattaactaattctaaacyaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctsaagtgattctcctgcatgagcctcctgagtagctgggattacaggcgtgtgccaccatacccggcttatttttgtattttttgtagagatggggtttcaccrtgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctytccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgwatcccagcttttccagttagtatctgtgtgactttggggaagtttcttagcatcttkgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccrtggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgkggtgtttttctacttgaacataaatgcacattttattttatttcmagactttttgtggccagcacccartgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttyactatagttatacatgccacackgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctakaytggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccytgtggccagcacttagttaagaataggtcagtaacagcaygccagaagaccacctctccaattgayttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcraggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtrgttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaaccwaatcctttaaaaaaataaaacataaagagtttgaaatgcttaatctttcattaaactctcaaaatacaaatgcarctacaaatgatgtaaamtatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatayggaaagagtttgtgcttccagtatccacctgtttatgtaggcaagattggccttgttatctcyccccttatttctctgatggaagaccaagtgctacagcttaagtaagtcatgttatcattgccacamtatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactrtagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtscaacatcccagcttgcttccttggatcagcacagtcagaaaatgttctaacagatattaaattgtgagtaatttttttccctcaacttttattttggatttatgggggtgcatatgcaagtttgttaygtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcayccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgrttattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtsagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaaygcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctgrctgatctttaacttaagccattctaatagtatctcattgkatttttagtttgcttttccctaatgactaattatattgagcatttttcatacacttattggccatctgtatatcttctttgagggagtatctgytcaaatcttttgcctattttttcttagtgagttttgatagtcatttctrtattctgaatataaattayttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcascatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatytgattccttgtgaaagcacaatgcctagcgcacaatagacacttaaacttayctgttgaatggacaggtgaatgcttttaaagtctttccatatagaaaattaagtttcattacatttgacttgatctaggttttcatttcatagaatggagagcagactctgtaaatattttgccccagacctagcyttattacaaacattgtcttaattaggattctgtctacccagaatrgaaattaactcaagctagcatgagtgtatattgaaatttatattaaggataaaggaatgtctcatagatcccactcaaaagaaattagccagcccttaggaagagactggaattgggtttggaaratacaataggtctttctttttatctgtagtctttagtgagtcttcctcatttttctctctgaagagataagcattctctgcatatatatagcattcttttagattttcgtgacataaagtattatttaaacttycataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggyctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgstgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtagrtaamcaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacrtgtaaatataraattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcayggcttctattgcaaatgcccctatttcccaccttcagttggcctaaccaaatttaatttttcaatatcatatgatctttttgtataattatgtattmaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattytgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacasctgtaatcccagcactytgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaawatcagtcactcactcaggtttagtttcaaaagccaaaacagtgataatattgaattttttccagccactcagtagtacccagagaattttgatacaaataactgactttgaccccatgtttagtaggttttttttttgtttgtttgtttkttttttttttttgtctttcttctccacactctcttaggackgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctrgaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtrgagaggctactacaggaagaaagaacaaataacatttcttcttactactttgtgcatcatgtgatttagctcctcccataccattttacattagaaaatgtggctgtcctcctgtgctctagtaytggcatttcagaggactctttgcaatatgatatgtgatcaatcatggatggcgatgcagttaatttcagtagaaatttgctgactctttttatctcttttaatagctaatgcatgagataaaattgaaggtatyaccaaggagaaatgcaggtggatagttttgraggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataaygatttttggtgttaatatgatgrtatttatgcttctgtttttataggaaccaaatactttgatttggttatttattctcctttggagatgtagatgagtttattttttcctttcgagctttatcttttcctttatgtgtttttcttttttacaggtatcacgctcattgctgtggatgaggctcactgtatttctgagtgggggcatgattttagggattcattcaggaagttgggctccctaaagacagcactgccaatggtaagctttgccaagtctgatgtccygaaattrcattcttaataaggagagcattcaggattggggagtggtaaagaagctgaagacttyactataaaagagcaaatggataatgtaaaawgagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccrtatgtccttttactctaggatgctgtgaaatcctggttaccccttcttgtatcacattgaaaacctaaagtttgaactattctatagaaattttattaaagcttttggtattagaatttccctttcttccctaawtataaaaaatagcaaattttggccgggcatggtggctcacgcctgtartcccagcactttgggaggccgaggtgggtggatcacctgaggtcaggagttcgagaccagcctggtcaacatggtgaaaccctgtytytactaaaaatacaacaattagctgggcgtggtggcaggtgcctgtaatsccagctacttgggaggctgaggcaggggaattgcttgaactcgggaggtggaggttgcagtgagccgagattgtgccattccactccagcctgggcaacaagagcgaaactytgtytcaaaaaaaaaaaaaaaaaaaaaaaaagtgaatttttacatgaatattctacatgattggcatatttamatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctrtatgatagagcctattgctcctaggctgtaaacctgtacagatgttactgtaatgaatattgcaggcaattgtaatacaatggtaagtatttgtgtatctaaacttatctaatgtagaaaagrcacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagyaccacatgactatttttttyrgtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcrctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacagaacaaaccaaaaataaattaaatatactagttagcaagtttatattgagggaaaatcaaaccatgtgaattgmgctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttatttttttatttttgagatggagtttcactcttgttgcccaggctggagtgcaatggcgtgaactcacctyactgcaacctctgcctcccgggttcaagygattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatyattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattccatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgaraaaacgtttttcccctggtgttttcaagaaccctctttattagctaagtggtgagacatgccacctggtggttatagtagtatcatttttctcactgttcttggtgcttttcttctcsttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggawamttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagyttatcattaatttttatttatttatttwtttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtrcattttgcaaagccacaggtttgcartgttacacaagggccaaaggaggccatgagttgtctttggttgtggggccggagggtaaytgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctyaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagctygtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacytttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgagagtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaartagtttataatttttaataaattgatcttgttttaattttsagtcatattctagaagtgcttcttygcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacsagwtctagttttaggggaggcatgttgttacygtacyttagaatttctggaagatgacatattcatgcttttcctgataactgctgagtctcctgctstgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgawgccataaacstatatatttmaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacmtcatggatttaatgttttatttaaatgatttctgatttttaaaaagtaaatattgtwtccagaaggctgagaaacargttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttyttcaatccgggaagacattgtacgttgcttaaatctgagaaatcctcagatcacctgtactggttttgatcgaccaaacctgtatttagaagttaggcgaaaaacagggaatatcctkcaggatctgcagccatttcttgtcaaaacaaggtaaggatttaatggttgatgaattttggtaatgatttcctttttttttttttaacaacttatgtattttatgttatttaygatttccttctaatgcatatttaacatatttcaaattccacctagttttggttcaagtcaagcatgatgttatataatcaattcagtgattgagamtagtgtatttttaaaagcagaaaccaattctcctaatattttaataccccattctgttgcttaaacagggcatatactatttatttttattttttaaaattttacttatttatttatagagacagggtctctctgtcrtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacaygacttcagtcttaaggagcttagaaaaggtcaccttacaaacacagtggagcctgtattgtgttccaaggactattgtaggcgctttctatataaaatgatctaatttaatccctataactgctcagtaagttaygtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgygcgccaccatgccaggctaatttttgtattttttagtggagacggggtttcaccatggtggccaggctgatctcgaactcctgacctcaagtgatccacctgtgttrgccttccaaagtgctggaattacaggtgttggccactgcgcctggccagtttataattttaaacattaaaataaatgcttcttgtccaatcatggtgtctcacacccakaatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaaraaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatayccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactctttygatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataagrtttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtgrcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctrtggaaattgawcatttaagttgtttatacttctatggaaatcgtttacgcttttaataaagaagcacaagtttctacaaaatacattctaacagatgttttctataacattcagtctcaagattactagtaaatacttctttgaactgtaaaagcaatcyttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaayagtcaaaactgagttttggggacttcacacaaytcatttggatatttgattctccataatgttttaaattttcatgcacttaaatatatcattatttttgataggctttcttcctttagtcttttctttagaaggtagaaaggaagaattaaataagataaaaccaaaygggtctgaagcatgtataaagtatatatrtttgctcttttgttcttctttttctttagttcccactgggaatttgaaggtccaacaatcatctactgtccttctagaaaaatgacacaacaagttacaggtgaacttaggaaactkaatctatcctgtggaacataccatgcgggcatgagttttagcacaaggaaagacattcatcataggtttgtaagagatgaaattcaggtatgaggatcaatcatcattgctctccvttgctcatagtggaagtggatrtttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccartaggtgatgaggggaaaggaattggttatagaattccaggaagaaggactagcaggtgcaaagacactttgatatgagaacacatactgggttcaggaaatgtgactggtayggaatggttggagggaaagacaatgtggggtaggaatggcacaaagtatggacaaagaggcagggtggaaccgttagagacttgagagaacagttgaatgggtcggttggccaggttatakatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgtyggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattrgactggctcagtgggtgtcatagaggatttatwtgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggaractttgttggatgcrcctgattttcctgccaatwcacarcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttactyactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtygtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagarataatgcattatgtttcatcccaccatctttaatgagaagcttccatcttagattaayattagagaatgttaaaatactctgcaatcaggtaaggacgcttgaaacttcatyataatgcaaaagttttctttaacacaataaatattttgaacccyttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgcyagggacttaagttaacgaacaaattattcttacaaaaaggtrtaaatgtaaggttttcattcygctaaatatgtttgtcaaactgtgttgtgatttgttctcagtgtgtcatagckaccatagcttttggaatgggcattaataaagctgacattcgccaagtcattcattacggtgctcctaaggacatggaatcatattatcaggagattggtagagctggtcgygatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaakaaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgygatgtcttcagccatagttacttcaactaccactgattttgttactgattctttcttmccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagartaggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttytgaagagtgtgggcatttcttttcytgkttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtckgcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatayacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatrttataagtaaatygttgttttcttttgaaatatctgaaacctagttaacatggactttcatttgttcttgtaaagatatgcaaagctatttgggagattgtcatsatctgatatttgatattcatgggctttcttcacagargactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacrtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataaktaaaaaaaaaagtragaaagttgccaatacagttttacatattcctgtgmtgtttttaatcgacaggcaccttcttactgagatacgtaatgagaagtttcgattatacaaattaaagatgatggcaaagatggaaaaatatcttcattctagcagatgtaggagacagtatgtattatttattttrtgccaatagtatggatttatggatgatgctcttttaagacaacartttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaakcatcttgtctcattttgaggacaaacaagtacaaaaagcctccttgggaattatgggaactgaaaaatgctgtgataattgcaggtccaggtaaagatttcttattatagatggacattctaaaastctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaratgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaargaatcatttcaccaatgtatcagtcagggttcaccagagaaataggacgattgatattatggagatatatatatatatatatatatatatatatatatatatatatwtatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatyatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaagktctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactrtgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttccttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggmcgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgygccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcmtgagccatcacgcttgactaatgtttttgtaaataaagttttctcagaacacagccatgccttttgtttatgtgttatgtagggctgcctgagttaagtagttggctrcaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaycccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaammamaaaaaaaacamaaaaaaaaactagtaagaggkcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttktgtcatattttacagtcgttagcgtttaacaatttatagcataggatttgggtttttttttttttcattttaaagaaraagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattsttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcartaaaagagtaggaaggggaaggtgaaagaatagagaaaactatgtagtcaggatgtggtggaaccaaattgcaactttcttttttttttttttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgygcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatgrcaactctgcttgctcgtcctattattgacattattcctttctgtggtctgaggtgcctcccatgaaacttgcttcyaggacactaggattgagaaccatcrgygtaacatatctgttaygctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtarctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcrttgtgttaatttatcacattgcatttgggtgaatccctagactagtcttgcttaggataattaggaaaagttaactttcattgtatcaagggacaggtagaacaaaattgtccttttgtccaggaaacyattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactygaatgcttcatgtaaatactttctgagtttrtatttttagaaaggaacattttggaggctgaggcaggagaatggcgtgaacgtgggaggcggagcttgcagtgagctgagattgtgccactgcactccagcctgcgcgacagagcaagattctgtctcaataaaraaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtraaaygttccctttaaccaacttaggaaaaattaatatctttgtacatgattttgagctgtaaaataaacattttaaactgggaataattggagtttagttaaagagataatgtatataaatatrtaacatagtagcagcatataattctgtcttacacaagatttttctgaatagtataaacagttatgtagcctatctaggagtttgtgaatagagtttaaaattttgttttgaagctgcaaatttgattagaaattaaacagtraagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcacygagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaagktatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctcttctctcttctttttcttttttctttttttctctgtcagatacygttgtaaagactttgcttttaccggaaactgatacgttgggtcatgtaccctggccagtcagttctctttattctaacacttagccgatcarttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacytccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgcccaaatccgtaagctatgttctgtatagcagctttttcatcataggcagtttttactcttatcagtggacaacctacaaaattaactaaacacttaarcaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactcygctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagkgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctrgcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagasgagtagccttagcctcacttcctgcttatacctgtcatgcaratatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgktttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaatygcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgttkttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacrgggtttcaccatgttagccatgatggtctcaatctcctgacctcgtgatctgcctgccttggcctcccaaagtgctargattacaggcatgcygcattgcgttttatataattctcatggttctagtctcgagctgtaggattttgatcactgtttcaaacaataatgtgagtttgctaagaggtctaaataacaaaagctaagtgttccaaacayatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacytaacctrtatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaayrgtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttkcttctgcctaggttcatttttcagtttttttcttgtaacttctgcattttttgttgctatttatgtgattcaaattataccagtttataggcctctcacaagtaaaatgaattrcctgtttgtttttgtatgcctattttagtcagtytgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagrtgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctgrtgtgtagaagtggaaagggaatacatttgttgcttacttttttgtacctttacatgtgattgatcacttgtgagttttttctttcaaacatcttaaagcttccagagctttttctrgaaaaaaaaaycagttttaagaatcaccagttctaaaagggtaatatcttattcatctttctgagaatggagtatcatgattcatgaattagatacttgcatcttaacatttgaaataatttaattttattattttttagttyraaaactgtatcttcgggcaccaaagagcattgttataatcaagtaccagttgaattaagtacagagaagaaggtttgttttaaagaaattgttctgayttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacaccacacacacacacacacacacacmttctctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgrgagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactrtttatttttctttgtatgaaatatatacaggcatactttgttttattgtgcctggctttattgtgacttgcagatattgcatttcttataaattgaaggtttgtggcaaccctgcrtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgttttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccsatcatgtctggctaatttttgtatttttagtagagatgggtttttgccgtgttggtcaggtggatcttgaactcctgaactcaggtgatccrcctgccttggcctcccaaagtgctgggattacaggtgtgagccgctgtgcctggcccatctctaagtgtttaagagaaaggaagattcacatgtcyctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctygcttaacatccattctgtagctcatggatcaagaagtaaattaaccttttaagtattattatttaagaaatacagtttgtaatgctttagcttctgtagatagtgattatcagagatgrgtttttaagaggttttccagaaaaccttctggaaaatattcacyattctagaagtcatgaagaatatttgtgattcaggagagtaggtcagaatatcaatattaataggaatttggaagaagtygattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttygtcatattaataatttgtttatatatatttttaatataatatgataatattgtatttatattattaaaactacacaaatattatatacayactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatatttyagtatcatggtacagkcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctcatttatttccttctaacaaaatagatttggaaaatatatctaagttgataatatgaccatagcttccactgtcacatctgggaggtgactcagattccccctgctgcgatgcttatctctttgcyaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcwtaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgyacctcagcctcccgagtagctgggactacagaacatgccaccatgctcagctaatttttgtattttttgtagagacagggttttgccatattgcctaggctggtcttgaactcctaagctcaagcartcttcccgcctcagtctccaaagttctggcactacaggtgtgagccactgtgcctggccyctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagacyatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagctnnnnnnnnnnnnnnnnnnnnactccgtctcaaaaaaaaataaaaaataaaaataaataaatattctaagaccatactttaatggaggtgttttttgtttttttttgttttttttttttttttttggtgatagagttctcactctgtcacctaggctagagtgcagtggcgcgatcctctggctcactgcaacctccgcctcctgggtgcaagccattatcctgcctcagcctccggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaragaaagaaattataaaacatgattagttgtattatacgttgtttttgkttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtyaatctgttgtaaaaacatgtcagttatctacttttaaagatgatactaaaaagtagttgtccaggctgctgatgtctttctatttcattgggaggttttgtttttaarttggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacrttagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttwaaaaaaaacaactttaatgtttattaagcaagttttgttattcatgagtttcattagcctttwattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtratcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacwtgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgarcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctayaaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttggstcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttaygatatattagtggttatagtacctaaatttgaatagtgattctgttcattcattcattcattcattcaatattcacttccasgagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttrtagctcagggatactgcatcagccatattttaaaatgggactaacagtttaaaaactataaatattcacagtgttaagaaacaatctcaagatgcattargaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatrtttttaaaaacttgcttytcattctrkctcttctagtactgttttgatgctctttgaaaacaatctaattgctgtaacaaatgaccatacgtaggccgggtgtggtggctcatgcctgtaatcccagcacttcgggakgctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggygaccgagcaagackcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaayaaacagtccatagcttatcttacttactgaataaatgctctratttgacagtcatgtttcttaaagttccttacaaaggccattgcccaagaaaccaaataattmcattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcytaggactaattaatcaggagcaatactacaattarttggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactrtgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctrtaatgggggtagttttaaagaaattctgaaaatgaaaaacttaagtaaaggtttagttcattgtttatttcacactgagcatttactacctgaatgttttggacattttatttccatgactgragtggacacttttacaactcactgggttctttgctgrtctttctctagaagagcatagctgagagcaggattctgcctctcatgacaattggcatgcacttatcccaagcggtgaaagctggctgcccccttgatttggagygagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctaytttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctgggractactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccycccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgacacaatctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttaygaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatggraggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctaytcaggaggctgaggcaggagaattgcttgaacccaggaggtggaggttgcagtgagtcaagattgtgccactgcacttcagcctgggagacagagcgagactctgtctcaaaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaataaaagttaaaaaatttatcttcttttgccaataataaattaaccttagcttactgtaatgattyttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgartttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagasgcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatcsttcggttaatacactgtatgtaggttgtacatacaatatgaaaaagtatatttttgtagcctacttttaaatccagaatagaggaggttaagaaggttgtgataaccatgagctctttttttttttttttgrgacaaggtcttactctgtttcccaggctggagtgccrtggcacaatcatagcttactgcagccttgaactcttgggctcaagcaagccttccacttcagccttccaagtagctgggaccacacytggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattstgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagrgtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatrtaaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgkgatacatacatrcaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaayaatttaaagaacgtcttttcaggttdtcatttgaaaaatacttgatttctgatcactgatttgaattgagtgtcaaatatttgatatgttttgtaaattaggtgaagatgagtgagtaggttctaaactgcttgggtttaccgcactctggagcattgcagragaatgtgatgttggaaggaagtgctgaaacataattattggcttgcctatagkagggtgctacataattttagaaggtgtcaagaaaktgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacrattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttyctttctacagaatatttcagtatttctagctcataggttttctaaaataktctctgtaatttattttgaaatggagtttttttatcgtttacagatatgagtaaaattagcctaatcagaatgttarttcctgaaaacattgacacgtaccttatccacatggcaattgagatccttaaacatggtcctgacagyggacttcaaccttcaygtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatgrcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctytgtgtatggcatgagataaatagcaatcagatatattrtttaataatatgaytctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtgggragaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttytgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaawtacacaatattttatacaaattgttttgtagaagatttatttacagatgctcattcacaggtwaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggygttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttstcataaaatccctcagttacttttattaataataaccaaattaactctggattccagggtgtactyatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgygcctgtgtgtgtgtttttgagacasggtcttactctgctcaggctggagtgyagtggcgtgattatagctcactacagccttgacctcctgggctccagtgatcctrccaaagtgttgggattgcaggcgtgagccacctcacccagccttaaattatttttttttcaaggatgtttaacctgagggttagaggctctttggcacgtgagctgctgaaatgtgtgtgaaagtgttgtgcacrtgtatgttyctctttttttctgggaagtggatctgtagtgattcttagrtgagkctatgagacaagaaacttttatttttttcatttatttagcgaatgtttgttaagcgtactatgccttggccactctacagggtgctgattggaccagtctgtctacctaycgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtmtaagactrcatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagaygattacctgtgtggtttgccaaaggaagtgataccagcaagaaattaatggacaaaacgaaaasgggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagsatagttattttacaaattgtttttactgtcttttgaagaagttcttaaatacgttgttaaatggtattagttgaccagggcagtgaaaatgaaacygcattttgggtgccattaaatagggaaaaaasatgtaaaaaatgtaaaatggagaccarttgyactaggcaagtgtatattttgtattttatrtacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttmagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttagktaaaatataaaagtctcgtatattcccatttttctgcattgcattachagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagamgcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacarctggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctstttccttccttcccttcccttycccttccttccttccttccttcctgcccgtccgaccgccctgccttccttccttccttcctccctccctccctccctccctcctttctttttctttctcttkctttctttctttctctctctctctctctttctttctttttctttctctttttctttctttcaagcagtcctcccgcctcagtcccccaaaatagtgggattayaggtgtgagccaccatgcacagccttacataaagccttttctaatgagatggatagtaattaacaaatgtgagtttttgawattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaartggattgaatgcagaagtagatctgagaatacagccacttttgttaagccagacaatgagatttgcaaaatgtaaacaatgctgctgttctcagttttwaaaaatatgttttttaaaagtatttatgttaatgtgtacttggtttactactgctatttttaaataaaacaagaaacatttttaaatgtctgttttaatttctaaagtggtagtgatagatataacccatattaataaaagctctttggggtcctcagtgatttttttttaagagtatggaagggttctcagacctaagagattgagaaatgctgatgtaatgttttattataaaggtgtaccatgaattatgtaccttacttcatattgttggacattaaagttgctttcagtttttttgttttaaacagcactgctttgaccttttttaaaaaatgagtcagggtcttgctgtgttgcccaggttggagtgcagtggctattcacagacatgatcatagcatgctatagccttgaattcctgggctcatgtgatacttctgcttcagcctcctgagtagctgggactataggcgtgcaccactatgcccagctgctttgaayattcttgaaatgaaatatggtatagtctcataccatatcatagccagagggggagagagagaattttgttgttgttgttatgttatctgtagtggactttatgccttcccagcataaattctctctttccccatttttcgtgacycttgatttttgttggggttcgttccaaggagaataatttccatctggatattggattggcacctgtgacctcttctgagctagaccctagtaacagcrtttggatctggggtaggtgtgtggccaactgagctgctggttcatgcctttcctgaaatgagccctacctctgaatatttcagaaacatgggacattaacttccctttacttacgttaaacccctttgaatgaggagttgtttttcacttccagttgtgttcagttgtcacagaagcacagygatgtgattggtggaaggacccgtcaacagacccagaagatgtaaagtgtttttaatctcaaaggatgtggaatctcagagatagttacaccgagtagaggatgaagcggctcctggatggaggcagaggcttcctggatcttcaagttctgtatgggttgttgtatgaggttggtgcaaaagtgaggcaggagaatagggtctggaggcaaggaaactaaggccgattcacactgacttcctagaactaaatcaaaaggaaaaccccaattttccagacctaaataacaaaagtaccagatggctcctccctttcaactgcccctcccccacacctttctgcgtgrcacatggaaaattgaaagtatctctggttgcttctgcgtaggaatgtaacttygtaaccaatcagacggatcgcaggccaagtcgcctgcatagaaatgtaactttgtaacttcactttagcctctgattggttgctttccacaaccaatcagatgcttgcatagggtgtacctgttgtgacttcacaaagtggtggaagtggtggaagtggtggaagggtggaagggctatttaaatttttattcatcctctgattggttgtttcacttaagcctctaattggttcttgagtcctggagcctgtgaagggtactttattttcagtaaatgcatgctttttttgcttcattctttccttgctttgtgcattttgttcagttcttagttcaagacaccaagagcctggacaccctccactggtaacaaaagtaactggtgtttttgccattagaagtaatggcacagaacaagtacatgagagcgatttcttatggaaaattaaatggcgcataagtcgtgtgctcaggtaagggagctgggaaccggtagaggaaggtctccaacccacacccgtgggatctctgagtctttgaaagtccgtcctcaccctttgtgaagaatgggagcacggctggactcgtcaccgggggttttggggggctgaacttgtcatttgagggtgtagggaggttggatgaatcgcaggggtgcagggagggggcccactggagctccaccaggaccccagcaccctagatccaaacctggtcatgcttcccatgctcagaggcaaatctccctccccttggggggcggagtcagacgagaccccctctccatccttttccaggtccggygggggcgggactttaaaggtaaaaacagcaattacttttgcaccaacttatcttctaagtttcgctccctaccacctgagtgtgtttggaggctctggctcattgtacctgcctgatcaccaggtgcaagtagctgggccagaaggacctcggcacgttacggaatatttactacaggaacaggtgagctgaaggcgaattccccaggtgtagcctgtgaccatagattcagacaaagccctgactgttgcctggaattcaaaaaagctgtagccctaccagatagaataagaaaagaatataggattcttcctattcaaataggttgcatataattaagagcatgaacgatccaatggaatgaactcaaagtagtttttgagtgtaatagacttraagtgtcttatggaaaagaattgcaaaaccacagaaacagtgaagaaggttagttatagccttgatggggtagctgacttcagcagtctcagctatctgaaaagttatttaccagattttggttgggaacataatccctaaatcatttgagataatgtacttgtttccttactgggtaaatgtgtttaaaccttgagaaaatgtagacataagtagaatatagaataaattaaacctttggtagttatgttttaggattaaggactaataagtacatatttgatatttaagcatttgtaatgcttgagataatttatcctactcaagtaacagattactcttgtgactccaatgtaaaatatatcattgaaaaattagtatctgcttgtgatttttaagtagaaaccctgccatttgaaaggtatttgcctttattattggagatatttcatatgaatgtttaactttgttattgcatagaagtatttaaacagatttcacttgcaagagaaagatatctaataggttactcttaatcagtactaaattactacaattactatattctattaatatcgattcattaaaacccagagctttaattatgtctcagaaaattaattaaactttagcctcataatcagctttattttctaactcaatgtttaaaaattgacaagtatgtattatacttatttatgtcttcattcagtaaacatttgcatttgtagcatgcaagacaacatgctagacacacgaaagatggaataaatggaagaaaatgcaacacagatctcatgcttaagagggacagatttactctgaagattcaatgaaaaaacatccacaaacaacttttctacaagaaacaaaacattttaaagaaaacatttacttcagcygggcgcggtggcttacgcctgtaatcccagcactttgggagggcgaggygggtgcatcacgaggtcagaagttcgaaaccagactggccagtatggtgaaactgtgtctctactaaaaatacaaaaattagcctggcgtggtggtgtgtgcctgtgatcccagctactcaggaggctgaggcaggagaatcgcttgaacctgggaggcagaggttgcagtgagctgagatcaggccattgtgctccagcctgggcaacagagcgagactccgactcaaaaaaaaaaaaaagaaaaarraaaagaaaacatttacttcacataataagatatgagaaaaaatggactctctgaatgaaaaaaagaggagatcatgtgaaagatttgcgctttttttttttttaaagttatggactgaaacactcctaatcattaacatttgttattttaggggagtggaattggaaaggtggaaagggctatttacatttttataatctccatgtcttttaaatcaatatatattgcatttattcttttagttaaaattttaagaactctataaaaaatagagacagggactccctttgttacccaggctggtctcaaactcctgggattaagtgatcctcccacctcaattagaagggtggaagggccagctgtttaagtttctataatctctgttaaatcaaatgtatattgcatttattattttaaattttaaaaacttttttaaaaatagagawgggatcttcctatgttgtccaggctggttgtgagctcctaggatcaagtgattctcccgccttgacctttcaaagagctgggattacaggcatgagccaccatgcccagcctatttatttgtttatttatttttagaggcagggtctcactctcactagactgaagtgcagtggtgtgatcatagctcactgcagtctcaaactcctggactcaagcaatcaactagcctcagcctctgagtactgagatgacaggcatgtgccttcatacccagctaatatttttgtagagwtggggtcttcctgtgttgcccggaagagtctcaaactcttggcctcagcctcccaaagcactgggattgcaggcatgagccacaacacatggccctgcttttaaaaaatatatagtgggccaggctttctgggatgatgggcaaccattacatttgctttctctccattctgaatgtcagcctccatacacctctc

SEQ ID NO: 13200 - DNA, 65723 bp, Homo sapiens
  misc_feature (1)...(65723): n = A,T,C or G, or insertion/deletion polymorphism (see Tables 1-2)
accagggttgtgggttttgtcaaatgaggacaatgaagcaaaaaagggataagggagttaaggatgtgtgcaagggggtgagtaaccataaatttaagctggttaagtarggaagagaggacatgaagtagatgatgggcagtggcagagtagcagaataatagataagaggtcctagagtcaaaagattgttggagttagtgctaaagaaatgagctggaaagataggaggcatggccagaaagaggaatgaataaacaattaggaaggagttacagctactaaaaatgacaagatagggcacaacccgtgagtacatgactaarggagggtgaattgcaagctcattggtaagggcaaggttctgttttcttttcttactagcacagagcttggaacatagtaggcactcattatatatccgttgaatgaatgaataaggaatgactaccacctccccagcagctctaattgaattcctggcttctctattccacccatttgctctcagtccaggattggagaggcaaaatggtttcaggtcaatgcaaattaccacgggtgatccttggtacaactgtgaaacctgtaaagttttattastggctcttgcttttctttccatgcatttatagcactctcctgtgcagagcttctarggcctgggtgctcccactctctcctgtgcccctatttcctccaatcccccaaacctgctctggaaaagaataatattgctcatttacacttcagtgtatgtctctgtttcctctcctagaggggatgtatgtttacatctcatttctgattragggaatataaggtttggtcccccgtgaaaacattgcaggtgtcaggaaggcagggcatggtgtctggggtcaggagaacttgtgttcctgaaatcagaccargaaagctgctgcttttccagcctctgccctttatggttcctgaattgggagtgctgagtcagtggaagagtctcataggagaccagtttgcttctcttttctttcctctgtactcacggcggagtttgcagtccggattctgcaatcccagtgttcccagaaccaagctgggtctggctacgttttctcaaggcccaataatgagaagcagacaaactgggaaagaagggaatttattgctgtaaccggattcagggagaaggccagagataattccaccagacaaacccagagtgttaccattttcttagtgctcatatagttggtgttatgtgcctacatgcagtatcgcattcacttaagtctattggtaactaattttgtttcagctataaggtcagaggcaaaaaatgcttgctaagtccaacgaaaagggccccagtaccttcaaggcctgtctactgtggtaccggagtgattatttctatgttatctcctttacagcttggtccagagagctrccttaggctctccaatgaatctattcaaacactgcctctgtyacctttactcatctaaaattttgtcaacctgagacgaagtgctggcactaggaatgtaagactgtctctattattttgtttgctctaggttagggagaagactatgcaaggctcctactgaccatgtttcatttctagctttgatgtctaggcattatttccctaggcttaactatttgctcaatgttaaggcagctctgtggaaatttgtctgtgtaactagggtgctatgcaggcctgtctgtgtgacggtcatgcctgcytgtctgtgtggttgtcagggagaattgacctgccacactagcatgtgtaaggatcctcatcaggcaagaaaaagtgtgrgtggccagtccacacctgttactgggaggctggcactgtcacctcattccaatagctctcaaaagacaaacctctgtgagttgggccaaggttcaacaacaataattcctttttgtcctttaacttctgttttaattaactttattgaggcatgatttacatgccataaaatgcacatacttcaagtgtaaagtttagtgacttttgtaactaacaccccaaacaagatacagaaaactttcatttccttagaagtttcctttgtgctccactctggtagagtcccccttactcccaccccaggacccaatggctctgtttgctgaccctttgaatgagttttgcttgttctagaagcctgtataaatgggatcataccgtatgtcctgtctgaagtctagcttcttttgctcagcataatgggttctgagattcattcrtgtggcatatttcattttactgcagactagtattccattgcatagataggacacaattcattcgcctgttcacggtcatttgtgttgttaattttctctaatttttaaatgatcaacacttcttgagcttcattaactaccaggaacttacgtaagcctgggcactcacaactggcaggaaaaatgaagtcaatagatagaacttttaaatgtttctctctgatacattcccttcagtccagtctctccatcccttccgctggtgggcataggcagatgactgagcagatgtgtggaagggactccagagaggtccccaaggctcggttcacctgtstgctgtggattggttggttggtttcggacacatgggtttgtgccggtaatttttatatcatgcgttaacttggttgccccagttttaagctggaattgggttgctcaagggttcttcttggtgatctgccaggcagcccactgactgaactaatttggaacccaccagctgataggaaatcaagctccatggagaccatcaagagtggtcacacttgcctggractccagccccaccactcctgtgtgataaagcactgggagccacttgaccatcacttcagagaatatcagaacttgatgtaactacattgggcattgagccctccccaaatgcacatttaaatactccaatccaattatatgcatgctgctagacaaataaagccagaccctgcatttcttggacaacttgtctccaaatgcaacttcacctgggaagaaactgctggatctktgttcckggagataaaagtgtctgagtaagacttcagaagagactgtaccatatttcctaaattgtgtgttttgtatttatagaagatttaaaggatttttaagggattcattgacagtgcaggagtttcgtatgacacgctcttttgatataaaatgctattctgcatatagaacttttgtttacaaatgtacttactcatttattattttatttgatccacacatccactctatgggtaaacacggcaactctgggcatcccattttgtaatggggatgctgaaacacagagctaatgagagggccaggactagggtaagcaaatgaggagggtcattgtacgtgcaaagtgggattctgtcttcctttaaaatgatgatattttgttcatcgcagaatttttgmattaactttgattttttaaatatattgcactaaaatattatttatcttgattattgaatcttttgtactcaagkctagtgaattatttgcttcatcytaatccctgagtctcaggccctgcaaggtgaatggattagcttgagtcatataaagtatccatttattgcatatgaaaaacagataaatatytgtcattccatatgattcaacytaatggatcctcytaggatggagtcaggaggccacactgcacatgagtgcttcaattataccactcggtggtcctaagcctggtgcacattagagctcyttctgaaatktttattaaaaccagagcctcargtttgggatgggaaactggcattcctctactgcaaacctctggattggaacccctggattaaaccagaattaaatcagtctatagattgaggcagagagtctggattcaaattctggtgtagctctttataaccacacaatttaaggcaagttgcaagttatgagtgttgagcaatgtatgcaaatgtttagcacagtgtctggcattaacagtaaatcctggataggaattaatgcttgcacaagccattactctgtgtggaagttcagagaagtaagtcaaccaaggtcacacagaaagttaatgaaagagttgaatttgggacccaagtctctctggtctctagccagaggtgaagtgactacacttgacatccactaagtgcttcctttaagaacagggatcctcaataattagcccatgacattttctaataagtcccctccccacacccatgagaatcaaagatgagctgaccaggcagaggcagagggagagcagggagctctgccargctaagtgagcgggttcctttgcctaggggactgccctccagtgggcaaatcccctgtgtcctcaattatctggtcctgtctaccccccagactctagctggagccatcacttcctcatttccaattttcctctttaaatttttctgtcctggcttctgctgcttgtcctctggcggaaccagtgacttcctgaatgttgaaattgtgggcgccacgggggacctctgcttttcagggcactgctaggagctcactttcctgagtttcatcccctttcactttctgacataccacgggccaaagaaagtgacttcgcctggcacagcttcacttcctgccacctgtcttcctcacctcttacatttcaaataggccaaaagtctacggctcccctgctccaggctgtcccacctctgagaggctgcacctgccctccttcctccctggagggcctttgcctcatcttgatctggatcaatcccccattatccttttaagcccagctctggtatctgrtatctcttgattcagatgataaagctatttgtcatatttctgccctgtctcccctgcctcccggcacttctgtcttttcagggacatcaacctttgccgcacttcacagcaattttctggaatgtagttgtagccgcaaccatcttgcatggtagactgtgaatatctttcatgaaaaaaggccatttcttcatctcctcggtgcccagcaggctcacaatgtctctaatgataataacaacaacatgaccatagtgtttattacctaatacttccatcctagccaccttatatgatttaattcatttaaggctcacgaaattcatatcttccttatttatacaaacagaagagtgagatgctcaaagctcaagtgatttgcctactgccagacagcccctatgtggaagaggtggaatttgaagccaggcattctagctcttagtgtctgtgtcttaaccaccatgctatacagcatccctggtagagatgcctgacgggagggagagaggggagaagctactttccttaaggagctcagatctcactggggcctggacaaggacacctgtaacacatgtacacatgtgcacacatgtgtacacacacagagagagaacatgggaaaactacaagaagaaatactaagtgctaaaatgtgtggttcagagcaaggcttctcaaactgtaatgtgtatataaatcacctggggatctagttaaactgtagatttggatttgatctgatggggtgggaccagagactcattgttagaacaagtgaacttgcatttctaacaagttctcaggtgatactaatactgctggtccatggaccacactttgagcagcaaggatgaactctaaaggttgaggcaggtcagagaagggagatttcactgtgggctggagaggtcctgggacagagagctgagtctgggcccatggcagggcttggttggccctctctggagccatccagcttttgggtctcagggacctgggagtgasgggtgcattcagaggcccgtaacttgtgtcccaaagcctcctcgatcccccttaacaagcagcagcactgtgtgggagatccacatgtgaatagcccgtgtttgagaaatgtccaatcctgatcatgtcaggaaacatcctgcaaattctgaaatcagagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatggtaaagtacgattccccaataatggaaatgaccagaaatgtagtctttctgctagcgagatacgaaaatagacaagtcaatagaaagtctaggtttggcttattgctgcattttgcrcgtaaycatcactaatactgtctggagtgcttcaatttggaatttctggaatgctaataatagatgctgtatttttagcatatagtcargtttttcttagcttcactattgttttaatcatatttaaatattttcccttgaaaaaatgccaatgcttattaaatgtcccctttttttaatgaatgtcttattctgacacacaggttgggtgatacaatgaaaacgcaaaacaggggcactgaaaggggaccacaaaactgaagccaagcatgacagttttcaaaacacagcttctttaaarttctttaaggggatttctgttataactgatgtgctggtcaggaaacatattctgtatttcatgttgactgaaatatgttcatagcttcataattagtttgtcttaggttaaactcaggtctgtaatattcagtcaactctgttgtctttattttctcactcagcattcaacaggtgatgcatttttaaaatcttctagaatttgtagcatttgaagtcatgggtgggcttgcattccacaaatgagctctgatttcctagtctagaacgttctcttgggatcatcttccaagttgatcagtcatttccactcccaggctttgctggaagttgtctatgcaggaaaattggtggctttatctcctggccagagtgtccttctcatcccacrcctgtctgcccaggtccctgcctggaattttcagcgcacaaagatgaagcgtctggggctctgcctctaggaatttacagtgtaataacagagaaaggtgtgagtgctaatggctataataatcattggctatttagaacttctcagaatgcaacattctggatacatgactgtttaagagactgaagatgttcaagcaaagtcagctgatcaagcatactcagcacctatttccagcagggcactgcactcagcactgaggaaacaggcttgaataaacatagcctctggcctctggcttctggcacgaggggacaggggacagggtaagctgcccatgaactgacaatttccatgttgtgactgagacttccacaggacatgatggacagatctaaccaggtgtagagccctggagggcagagctgacacctcttccaaagtttaaaggataaagggagtccgttagagaaagaagttagtgcctggggcggggtgggcgccacatgtttgtattgtattcacaagaaatattcagagaaatataaatacttccatactgtttggccaaaattgggacggaaagaccagtggggactgaggctggaaccaaaaaatttgacttcatcctgaggtcagtggggaagcaggaaggggccgatgtggggctgaaaggcactaatgtgcatgtgaggttgctctttgtcctacatagggatggctggagagagaagctgaggacagagaggaacttggcagcaagagatgatgaggggcagtggatggaaggcaggaaaataaaggaatgctctggagaaacaccggaaatcagatcaattggactgcaatggcaggacagggctggggaggaagacgcaggagttaatagtgaaccctagatttctgacctgggttgtgtgtgtcaccaattaaaaatgtaactaagccagtgcaggaggattccttgagcccaggaatttgagaccaacctgggcaacatagtgagaccctatctccaccaataaataaataaataaaatgtttaaagtatctcaccaaaaaaccaaaactactccaatttggatgaaagaaacattttcttatatgcattcacaacatcctgccttctaatacaaagattgtggaacatatgaaactttctagaagagtgccattatgcaggtaatcactgtgaggctctggtaacacagtgacccctcagggccggctctgcacattacttattttttgtctgctgaagatttatttatttaggccatatatagttttattttcttttgaaaatacattatcttaaaattcccacatatggttcatgaaaaacagcactgaaaaatatttctaatgtcattttcctcatttatttttctctattgttggtattgaaatataaaatgctgtttttccctgattataaagtattaaactagttttttttttattattattacccaaggatactggactaggaaagttttcaacacatgctgaagaaaattttagaagtgagtttgggaaacttttggaatataaccttcattttttctaaaattaatcttaaaaaaaggatgaggagtgtaaatttcacactgtaccctctagaagcacagtgcaacttgcatccctctttcctgccatcacctccagcctccctcattagaacaagcctccttcattccattatctgcactagaattaaggtactctttcttttctttattttttattctagctttttaggagtgtgattaacaatacaaactgtatatatttatgatgtacacgtgatgatttgatatatgtatccatggatgaataaccaccacaaagactgctttagtttcctgaggggacttgacatagggttggcttctgtggccctcagggtctcacagaatcccaggtctctcctcagagccatagaaactgctcttttgccccatcatccacctcaacaatggaacatttgggcttgaacgagaggatttacctgttggcaatatctttctgggatgtgtctgtttctacctttttgaaaattagcaatctgtgtctggctttaggcttcctgtcacactcctggccgtctggtttctcaaggaagactactgttaccacagcctaacaagacaagcacttgttaggctgtgcaatgtgatctgtcggaacctcttgtttcttttttttttttttttttcttttttgagatggagtctcgctctgtcacccatgctggagtgcaggggagcgatctcggctcagtgyaacctccatctcccgggttcaagtgattctcctgactcagtctccctagtagctgggattacaggtgcccaccaccatgcccggctaacttttatatttttagtagagacggggtttcaccatgttggccaagctggtgtccaactcctgacctcaagtgatccgccccccttggcctcccaaagtgctggaattacaggcatgagccacctacctggccctgttgggacctcttactccaatctctcaactacttcaggcttcccaccaacttcagtctgaagaacattcttcttgagagagaagtttgaaacaaaatacaggtagaaaagttagggtttttattgttgtttgttttaattaacactaactattgtctctcagtagtgagcctaaccatcctttcttcccacccttaacatactctagagcaaccttcaacaaaacccaaaccctcaagtccgttcaggctcagtcttgcaacacgactgctattatttcatgtcattgttctgactttgctcttcatcatgccaatatttctcaacatcttttaaacatctggctttattgcagagtttagtcttaactttttatggtgaagtagttatagagtcagagaaaattgcaaaaaatgtacagagaagcttttctgactcttgtctcattctcccccagtggtaacatcttacactgcattaatacaaaattacaaccaggaaactgatattggtgcaatccatagagcttattcattagttttacatgcactcgtctctgtgtacatatatagttgtaccaattctatgcttaaataaccccacatacccctcactcccccaccagcagtcatcaacccctggcaaccactaatctgcttcccatctctataattttgccattttgggaatgttacataaagaaattacacagtatgtgacttctttaagattgatttttttttcacatagtgtaattcctttgaaacccatccaagttgtatccatccatagttggctcttcttattgagtagcattccatgatatgaatatatcaaagattgtttaacattcacccactgaaggacatttgggttgttttcagtttgggggctattacaaataaagttgccatgaccatttctgtaagtgttttgtgtgactttaagttctcatttctccaaggtaaatgtccaaaagtgtaattgctggattctaagtgtgtttggttttacaagaagtagtcgatatattttccagtgtgactataccattttacattcccagcagcaatgtacaactgatccagttttctgcaacctcgtcaacatttgacattatcactatttttaaatgtagccattctcgtagatgtatactgatatttcattgtagatttaatttacattttcctaatggccagtaatgttgactatcttctcatgtgcttaaataccatatgtatagcctcttcagtgaaatgtctctttgtgtcttttgcccatgttttaattggatcttttattttttatggtttggttttaagagttctttatatattctatatataagtcctttgctagatatgtggtttgcacatattttctccgagtctgtaacttgcattgttatsttcatatcagcatcttttacaaygcaaaagtttttaattctgacaaggtccaacctaacaatttttccatgtatgtattatgctttcggtgtcaagtctaagagttctttagcccttgttggtgaagattttcttctctatcttattctaaaatttttgtagttttacattatttttatttttatatgttagagacaagatctcactatgttgcccaagttggagtgtgcagtggctattcacaggtgtgatcatagtgcattgcagcctcaaactcaygggctcatgtgatcttcccacttcagcctcccaagtagctgggactagaggctcataccaccatgcctgcccgtgatccattttgaattgattctcgtataacgtataatgtgtaggccaaggttttcatatgtttcattttgttgaccatggatacatagtcattccagcaccatttgttgaaaggctatcctttccctgttgaattgcttttacacctttgtcaaaaacaacttgggtaaatttgtgtgcatctcattctgcattctttattctattccagtgatctatgtgactatccctctaccaataccacagtgctttgattactatagttatattgtaagcgttattatcaaatagagttattcctcaaattttagtcttcttttcaaaactgctttagctattctagggtttttgcctttccatataaatttaagtgtcagcttgtctacggttacaaaaagatcttgctgaaattttgataggcattgtgttacacctatagataaatgtagagagaattgatatctttattattgcagacttacaatccatgcacatctctccatttacttaggtctttggttcttttaactaaatttttaaaaaaatttcagcatacagatcctgtacatgttttattagatttatatctaaatattccattttctttggtgttagaaataccaaaattgttagaaatagataattggtgccaggaagaaaagttagcacagagacaaaagatctctcagcaaggccatctttactttctgcagaaagggtgctcaattacagatggaacaatggcaagaccacacctgaacaaaagaaaagcagacatatttatcccttacacatttggttcatccttactgctgtgtcctgcatctattggctggagcaggacctcacaatcttaaactgatacccgatttgctaatagcctacaactttcctaatagttaagtacagggaagaacaaagaaattgcttacaraaggtttaaggaagcaataacatttccaaataaggaaggagcatagggtgtgagctggaacgtgcctgtgagcatgttcagcagttacataggctagggcttaacaaagagttattaaygcaaagcaagaggcttgaagaaagttattcctcaaaagaaaccatcatttccaacactcacaatttattcttcaacaagaaggaaaactttgaagaggaaatttttactttctacaatccctcctcttttactttttagttttcctcttcaaacttgcttaacatgtcttggcttagttgttttgattaactcttggatgtatggtacaacataatacttaagaagaaggagtatacttattatagttgttgaagaggtaagaattgaagctatgtttgtttgtttgtttgtttgtttctkgttgatgaaatacyagagtaaaagggataggcaattgaactagagcaaaagtattgctccaattatttggcagagtgtccagtaatggtcctccataataccaccatacatccgctaagggcaggtgtatgaataagggtggactgatgggtcagctcttggaagtgactgacttcactgcatcctgttaagtctccaaggaatgccagatttttccccttgtcattggatatatgaggtaaaattggttttggaagatggaggctggatggccctcgcaggctgatccgcagggtgttgaacttcaggaaatagcagaaaaagagcttggcacaattctttattccagggggtggaatcttgaaaaagagctaccatgcactccatgtccccttgatttgaggaccatgctagtggaaaggcaacaacgtgggcctctggcctaccttgcacacaagagtagcagtcacttttgtttaaagtgcaaacagaatatttaatctattttaaccaggcatttacatctttataccctgtttcaatggctatggtttgccataggtctcctatttctactactgagaccttgcttttgtcatttggcatgaggcgagtcatagtttgattttgtaggtttgggaaaggkgcagttgtaggaggtagaggagggagaacaaagtgcaccttaaagaagcctataggatcctttccagtgacttctgctcctaaaccacagaagtgccctacagtggggttagagttgctggtggtaggaatagtaatggatttaagcactgggttaggaaaggaaaggaaaagatagatagactaagctttccttagctttaatttggtagggcttgacccaggaacaatggcccatgattctgaggataatggcacttgcttgactcaggtgtcatgtgtccatccctttccgctgtacgaacagcagtctcgatggttagcagcacaaggtacggtccttccaaggctggcccgagtttcccttctttctatcctttgatgagaatgtgatccccaggctgatgctgatgtactggaaactccaagggcggcatctgtgctaaaagaccttttgtttcaagggaagagaaggtggaggataaaccaagtatataatttctaagaaattgatcttttgttttaaacgtgggtacatcaacagtggactttatagtcctttgtgccttcttgctgataaattttctttagcaccgatttttattagtttttagaccaaagaaagccaaacaccattttatatttgacagtgcttcgtatatgattttatactagaaaagctaaattttacctttatatgagtgtgtcattaatgttaaatttaattttaataaaaccttgttgacatatgtatccaattttaatgtctgaccataaggtaagatttttatagactgtttttaaccttttataattttttgttaaagagcaggttagtgttttaagaaaaacctgttgttcttttattttaatatccagttcayagaaaaactggatgacacccctttaactttagccaatatgtttacacacagaatttcctttacaattaaagtttcaaaacttgcttaaaccttcaaaacaaaatttttttaaccttttaatgtaggtagaaatccacattcttatgcctccttataatccttttaccaaaagtttattttgctttccttacataccttgcatataaactgtttcttcaatagttttacattcaggaggcctaattwcttttaagttatacaacatttcttgcataaattcycttttataattttgtttttcacaacttttacagacaattcttcgacatgcctcaactttctgagttgttgctaacatcgctttctttaaacaaccagttaatttattttaggacaagaatttaccatataacattcctttttacataaattctccccycccccctttttttttcctcaaagatgatagccattcttttccaaagtgaacttccttcatgtctgtggactggactgttaaaggccacaagattagaagttaggataatacatatgacactgttaatatttagcaaattttacttttgttgaaaaccttgtaagtttgggatttcaattatcctttgctattaataagacctaatttagtccaaattyaacttagaattgctatagatgactccttcctgaatctgtaagtattttaaggcttggctgagtgcaaacagctcccacctttgagcagaccaattattaggcaattttcctaactctgcttctacaagagtttccttatcacttactgaatacccattgtgtccttttctctcaatcacctgggaggaaccatctatcatcctgtcaccaaggaggaaccgtcaatcatcctgtcctgaagggagttcctcctaggtctggtrggacctttctatggtaactaagatttagatccccgttaggaaacctactgagttaagggaattttcagtggctaacgttaaatcactttttctaacagaatagccgcataccttaaggttcttgagtcagtgagctaccttttagcttttgggttttgttgtttgtttgtttgacttaggttagttctggcctgatgaggtgtgctcacaatgaggtttcctctaaaagttatttttctactttgctctcttagcaaagcagttgctgctacagattgaatgcatttgggccatctacgggttactgggttaaggattttttattagaaaggcttcaggttgtcagtggcctcagtgctttcgggctacgcccctgtttacactgacaacaaggtggtattggagtgttatagggtcatgaagaagactttcaattatcaattacaagttttaaatttaccctggcttttaaatgactagggtacagttttctctttactacttccatctctctctttctctctcttccttgactctgtctctctctctcttttactmcctctttatctctctgtctctttctctcactctctgattctccatctctctctctctctttcttcctctttctctttgactccctctttgtctctccgcctctctctctttctctcccttatttcctctcccagtttctctctcctctctgctggtctttccctgcctctgccagccacttatgttgctgctctcccttctccttccccttcccctaggggagcaaccagcaggagtggagcttagcctctttcttacccctttcttacctctttcaggggagttctgaatatttttcttactaccggaggtttgtgtgaggttcaaccacctgaaatttgcagaaggttcaacccctcaaaccagggatgtcttgccttgcctgtcctggaaggctcaacccctcaaaccagtgggtgtcttgccttgcctgccctgggaggttgacctggtttctcccttcccytctctgaaggtcccttgcacacttcccacttgtgttgtcctctctggccgctcccccaagggagaattaggccccttttagtgttggcgtgcaggtataaatcccatggcaggatccgccctaagccatatgaggtagctayggaaccgcagagaggacccactcactccatccagcagtaggacttgtcaccatccacacaaacaacaccgcaagcagggttatctgtgatcattcacgcacaygtacatttagccctccagaatttcatgaccaaggaagtactttaccggctcctgtggctttgccttccttggtctgtgcacaaagtcrtcgctgcagtatgtgaggatcctttaagctaggttgctggccagtttctttctgcattgctgagagctcgggttattcctcrcaccaggtgggtcttggtcccttacccctgaggccaccgcaagaggtggtgtggtgcctcctcatgaaagaggactagagatgcccccggaggagaatgtatccccataygattgccaccaaaattgttagaaatatcaaaattgttagaaatasatcattggtgccacaaaggaaagtcagcacagagacaaaagatctctcagcaaggccatctttactttctgcagaaagggtgctcaattgcagatggaacaatggcaggagaacacttgaacaaaggaaaagcagacatatttatcccttacacatttgggttgtccttgctgcgtgtcctatgtccgttggctggagcaggacctcacaatcttaaactgatatccgatttgctaatagcctacaactttcctaaataggtaagtacagggaagagcaaagaagttggttacaaaagttttaaggaaacaataacatttccaaataaggaaggggcataggctgtgagctggaacgggcctgtgagcacattcaacagttacataggctagggcttaacaaagagttattaacacaaagcaaggaggcttgaagaaagttagtcctyaaaagaaaccatcatttccaacacacaatttattcttcaacaagaaggaaaactttgaagaggaaactttttactttctacatttggtgtgattgtcagttctattatgcttttaatttggtttccatttattgttagtatatagaaatgtggttgatttttgtgtgttcatcttgtgtcttccaactatgtgaatttatttattcattcgaaaagttttctggaggtggggggaacgatggtggatgagaggcgggactagatttctgctccagacagagcagcatgcagaggcttgcattgtgaattttagctccatatcaactgcaagaacaaaccagcaatcctgagaggatccacagaccctctgaaggaagtggactgctcctgaaggacccagtagacaccccaaatactgcgagtgccccagccgtgtaagtggaaaagggagaccctcgtctcctgaacacacaccctcactggagaagatgaaggtctgtttgcaggagaagtttctgactttacctggagctgatcaagttagagagctgagccaagtgaaatacaggggtgggggaagcagcagaaaggccctgggagcttgctgggtccccaagcagcccactcctggctggcaccacaggaatccatcaggaaggtggccagaggagcaggggcaaaactccacagggagaaaggattctctagctgaactttgtaacaatttgaacagggtgagaagcctcctgaccagaactcaggggagggtgcgaatccagcttgcagacttcacaggcaggagaagatctaaagcccttgtctttggcagctgggaggcagagaaagcctcaggcaagttttcaaggctgtctccccctccccctggaaacacacttggggctgttgctgggggcacagtgggagtaagactggccctttggtttgtgtgggagctgggtgaggcctgtgactgccagctttcccccacttccctgacaacctgcatgactcagcagaggcagccataatccttctaggtacacaactccagtgacctgggaatctcacccctatcccccacrgcagctgcagcaagacctgccgaaggagactctgagatcatacatgcctagtcccacccctggacctgatggtccttccctacctgccctggtggcagaagacaaargacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccsttagttggttcacatsagaggactttgtgcagacaacccccagtaccagcctggagctgggtaaagttgctgggtgactagacccagaagagagacaaaaatcactgcagtttgactcacaggaagccacatccacaggaaaacaggragaatactacatcaagggaacaccccgtgggacaaaaaaatctgaacagcaatcttcagccctagacttccctctaacagaacctacccaaatgagaaggaactagaaaaccaaccctggtaatatgacgaaacaaggctcatcaacaccacaccctcaacccccgccctgccaaaaatagaaaaaaaaaaaatcacactagttcaccagcaatggatccaagccaagaagaaatccctgatttacctgaaaaaaaattcaggaggttagttattaagttaatcagggagggaccagggaaaggtgaagcccaatgcaaggaaatctaaaaaattatatgagaagtgaagggagaaatactcaagaaaatagatagtttaaataaaaaaacaataaaaattcaggaaactttggacacacttttagagatgtgaaatgctctggaaagtctcagtgatagaattggataagtagaagaaagaaatgcagagctcaaagacaaggtctttgaattaacccaatccaacaaagacaaagaaaaaagagtaaaaaaatatgaacaaacctccaagaagtctggaattatggtaaacaaccacacctaagaataattgatgttcctgaggaaaaagacaattgtaaaagcttggaaaacatacttgggggaataatcaaggaaaactttcctggccttcccagagacttagacatggaaacacaagaagcacaaagaagacctgggaaattcgttgcaaaaagatcttcccctagayacattgtcatcaggttatctaaagttaagatgaaggaaagagtcttaagagctgtgagacagaagcacaaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccacaacaagaactgctaaaaacttgaactgtttaaatctgtttaaatcttgaaacaaatcccagaaatacatcaaaacagaatctctttaagtcatatatcacacaggacctataaaacaaaaatataagttaaaaagcaaaatcaaaaaaccaaaatgaaacaaagtacaggcaacaaaaagcatgatgaatgcaatggtacctcacatttcaatactagcattaaatataaatggcctaaatgctccacttaaaagatacagaactgcagaatggataagaactcaacaaccaactacctgctaacttcaggagactcacctaacacataaggactcacataaacttaaaataaaggggtggagaaaggcatttcatgcaaatggacaccaaaagtgagcaggggtagatattcttatatcagacaaaacaatctttaaagtaacagaggttaaaagagacaaaaagggacattatgtaatggtaaaagtccttgtccaacaggaagatatcacaatcccaaacatttatgcacctaacactggagctctcaaatttataaaacaattactaatagacctaagaaatgagatagacagcaacacaataatagtgaggtacttcaatactccactgacagcacaggagggtcatcaagacagaaagtcaacaaagaaacaatggatttaaactatacctttgagcaaatggacttagcagatatatacagaacatttcatccaacaaccaaagaatacacattctattcaacagtgcatggaactttctccaagagagaccatatgataggccataaaatgaccctcaataaatttaagaaaattgaaattatatcaagcattctctcagaccacagtggaataaaactggaaatcaattccaaaaggaaccttcaaagccatgcaaatacatggaaattaaataacctgctactgaatgaggattgggtcaaaaatgatatcaagatggaaatttaaaaattctttgaactgaatgacaataatgacacaacctatcaaaacctctaggatacagcnnnnnnnnnnnnnnnnnnnnttcccctagacacattgtcatcaggttatctaaagttaagatgaaggaaagagtcttaagagctgtgagacagaagcaccaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccataacaagaactgctaaaaacttgaactgtttaaatcttgaaacaaatcccagaaatacatcaaaacagaatctctttaagtcatatatcacacaggacctataaaacaaaaatataagttaaaaagcaaaatcaaaaaaccaaaatgaaacaaagtacaggcaacaaaaagcatgatgaatgcaatggtacctcacatttcaatactagcattaaatataaatggcctaaatgctccacttaaaagatacagaactgcagaatggataagaactcaacaaccaactacctgctaacttcaggagactcacctaacacataaggactcacataaacttaaaataaaggggtggagaaaggcatttcatgcaaatggacaccaaaagtgagcaggggtagatattcttatatcagacaaaacaatctttaaagtaacagaggttaaaagagacaaaaagggacattatgtaatacttcaatactccactgacagcacaggagggtcatcaagacagaaagtcaacaaagaaacaatggatttaaactatacctttgagcaaatggacttagcagatatatacagaacatttcatccaacaaccaaagaatacacattctattcaacagtgcatggaactttctccaagagagaccatatgataggccataaaatgaccctcaataaatttaagaaaattgaaattatatcaagcattctctcagaccacagtggaataaaactggaaatcaattccaaaaggaaccttcaaagccatgcaaatacatggaaattaaataacctgctactgaatgaggattgggtcaaaaatgatatcaagatggaaatttaaaaattctttgaactgaatgacaataatgacacaacctatcaaaacctctaggatacagctaaggtgttgctaagaggaaagttcatactcctaaagatctacatcaaaaagtctgaaagagcacagacaatctaaggtcacacctcaaggaactagagaaacaagaacaaaccaaacgcaaacccagcagaagaaaggaagtaaccaagatcagagcagaactaaataaaattgaaacaaaaaaatacaaaagataaatgaaacaaaaagctggttctttaaaatataaacaaaattgatagaccgttaacaagataaacgaaggaaagaagagagaaaaaccaaataacctcactaagaaataaaacaggatatattacaactgacaccattgaaatacaaaagatcattcaaggctactatgaataatacctttactcacataaactagaaaacctagaagagatggataaattcctggaaaaatacaacgttcctagcttaaatcaggaagaattagataccctgaacagaccaatagcaagcagcgagattgtttggtaatttaaaaattaccccccaaaaacaaacaaacaaacaaacagtccaggaccagacagattcacagcagaattctatcagacattaaaagaagaatactaaggtaccaatccttttgacactattccacaagacagagaaagaaggaaccctccctaattcattctatgaagccttcattaccctaacaccaaaaccaggaaaggacacaaccaaaaaagaaaactacagaccagtatccttgatgaacatagatgtgaaaatccttaacaaaatactagttatggtggatatcataaagataatccaccatggatcaagtgggtttcatagcaggggtgcagggatggtttaacattcccaggtcaataaatttgatacaccacataaacagaattaaaaacaaaaatcacatgatcatttcaatagatgcagaaaaagcattcaataaaatccagcatccctttatgattaaaaccctcagtaaaatcagcatacaagggatataccttaatgtaataaaggccatctatgacaaacccacagacaacataatactgaatggggaaaaattgaaagcattccctctgagaaygggaacaagataaggatgctcactctcaccactcctcttcaacatagtgctgaaagtcctagccagagcaatcagacaagattaaaaaaaaagggcatccaaattggtaaagaggaaatcaaactgtccctttttgctgatgatatgactgcttactttgaaaaccttaagggctcctccagaaagctcctagaactgataaaagaattcagcaaagtttctggatacaagattaatgtatgcaaatcaatagctcttccttacaccaacagtgaccaatcagagaatcaaatcaggaactcaatcacttttgcaatagctgcaaaaaaaaaaaaaaatacaatacttaggaagatacctaacaaaggagtcaaaagacctcttcaaagaaaattacaaaacactgctgaaagaatcatagatgacacaaacaaatggaaacacatcccatgctcatggatgggtagaaacaataatgtgaaaataatcgtactgccaaaagcaatctacaaattcgatgcaatccccatcaaaataccaccatcattcttcacagagttagaaaaaacaattctaaaattcatatggaaccaaaaaagagaaggcatagccaaaacaagactaagcaaaaagaacaaatttggaggcatcacactatctgatttcaaactatactataaggccacagtcaccaaaacagtgtggtaccagtataaaaaatagcacatagaccaatggaaaagaacagagaacccagaaataaacccaaatacttaaagcaaacaaaaatataaagtggggaaaggacacccttttcaacaaatggtgctgggataattggctagccacatataggagaatgaaacttgatcctcctctctcaccttgtacaaaaatcaactcaagatggattaaggacttaaaccaaagacctgaaactgtaaacattatagaagataacattgggaaaacccttctagacattggcttaagcaaagatttcatgamcaagaacccaaaagtaaatgcaataaaaacaaagataaatagctgggacctaattaaactaaagagcttttgcacggcaaaaggaacagtcagcagagtaaacagacaacccacagagtgggagaaaatcttcacaaatctatacatcggacaaaggattaatgtccagaatctacaacaaactcaaacaaatcagtaagaaaaaaaattccatcaaaaagtgggctaaggatatgaaaaaacaattctcaaaagaagatgtacaaatggccaagtgacatgtgaaaaaatgctcaacatcactaatgatcagggaaatgcaaatcaaaaccacagtgtgatactaccttactcctgcaagaatggccataataaaaaaaatcaaaaaaaccacagatgttggcatggatgtggtgatcagggaacacttctacactgctggtaggaatgtaaactaggacagctgctatggaaaacagtgtggagattccttaaagaagtaaaagtagaaataccatttgatccagcaatcctactactgggtatctacccagaggaaaagaagtcactgtttgaaaaagatacttgcacatgcatgtttatagcagcacaattcacaattgcaaaatcatrgaaccccaacaagtggataaagaaactgtggtgtatatatgatggaatactactcagccataaaaaggaatgaattaacagcattttcagtgacctggatgagattggagactattattctaagtgaagtaactcaggaatggaaaacsaaacatcatatgttatcactgatatgagggagctaagccatgaaggcataagaatgatatagtggactttggggacttggagggaagagtgggagggtggtgwcggataaaagactacaaatacagggcaatgtatactgcttgggtgatgggtgcaccaaaatctcacatatcaccactaaacaacttcctcatgtaaccaaatacaacctataccccaataacttatggaaaaataaaataaaataataataataataataaataaaaataaarctttttttgtagattttgtggaatggtttatgtagatggtcatgtactctacaaataagaacattttaatttctttctttccaaactgtatgccttttatttctttttcttgccttactgctctggctagaacttyccagtgctatgttgaataagaaggcaagaacatatatccttgccttgtttcgaatcttaagggaaaagtgtcctgtctttcaccattaagtatgatgttagctttagatagtttgtagatgcagttttttaagttgaggaagttctcctctatttctagtttgctragaatttttattgtgagtttattatttgttatgagtcatagttttgaattataatgatgagagttttactatgaattggattttggcaagtgctttttctgcactaattttatggtttttcttctttagcttgctgatctggtggaatatattgattaagtttaaaacattgaaccatccttgcatatctggaataaatcccactttgttgtggcatataattttttaaatatattgcttgatattatttactaacttttttatgcaagttttttttgaaatttttatttctattttaagttccagagtacatgtgcagaatgtgcasgtttgttacacaggtaaatgtatgccatggtggtttgctgcacccgtcaacccatcacctagatattaagctcagaatgcatgagctattattcctaatgctctccctatacccccaccccctgactggccccagtgtgtgttgttcccctccttgtgtccacgtgttctcattgttcagctcccacwtataagtgagaacatgcagtgtttggttttctgttcctacattagttttctgaggataatggcttccagctccatccatgtcactgcaaaggacacgatctcattccttttcatggctgcacagtattccctggagtaaatgtaccacattttctttatccagtctatcattgatggacgtttgggttgattccatgtctttgttattgtgaagagtgctgcaatgaacatacatgtgccatatatctttataatagaatggtttgtaataggattgctgggtcaaatggtatttctggttctagatctttgaggaaacaccacactgtcttccacaatggttgaactaatttacattcccaccaacagtgtaaaagtgttcctatttctctggaacctcaccagcatctgctgtttcttgactttttaataatccccattctgactgatgtgagatggtatctcattgtggttttgattttcatttctctaatgatcagtgatgttgaactttcttttcttgcgtatgttggctacatgaatgtcttcttttgagaagtgtctgttcatgtcccttattcactttttaatgaggttgtttttttttcttgtaaatttgttcaagttccttgcagattctgaatattagacctttgtcagatggatagatcgcaaaaaattttctctcactctgtaggttgcctgttcactctgatgatagtgtcttttgctgtgcaaaagctctttagtttaattagatcccatttgtcaatttttgcttttgttgcagttgcttttggcaatttcctcatgaaatctttgcccatgcctatgtcctgaatggtattgcctagattttcttccagggtttttatagttttgggttttacatttaagtctttaatccatcttgagttaatttttgtataagatgtaagaaagggatccagtttcagttttctgcatatggctagccagttttcccagaaccatttattgaataggagatcctttccccattgcttgtttttgtcaggtttgttgaagatcagatgctcgtagacgtgcggtcttattgctgagttgtctattctgttccattagtctatgtgtctgtttttgtaccagtactatgctgttttggttactgtagacttgtagaatagtttgaagtctggtagtgtgatgcctccagctctgttctttttgcttaggattttcttggatatacaagctcttttttggttctgtataattttgagatagtttcttctaattctgtgaagaatgtcagtggtagtttaatgggaaatgtgttgaatctataaattactttgggcagtatggtcattttcatgatgttgattcttcctatttatgagtatgaaatgtttttccatttgttcacgtcctctctgatttccttgagcagcagtttgtagttctccttgaagaggtccttcacgtcctctattaactgtattcctaggtattttattctctgtascaattgtgaatggaagttcattcacaattttgttctctgctygccttttactgaagatttttgtgtcaaagttcatgaaatagttttgtttgtttctttctttctttttactggactatctttgattttcatattaggatcattctgatctcataaaatgaattagaaagtgtttcttccttttctgtaagagattgtgtaaaactgatgctaactcttctttaaatgtttattacgatatgctggtaaaactatctgggcctgaatatttcttttctgggagcttttaaattaaaatttagatttatttaatgattatagatattcagattatctatttcaccttggctgagttttggtagtttgtggcttttcaggaactagcctatttcctttaaattgtgagcataaagttagtgatagtattttcttattttctttttaatggctgcaggatctgtagtgatagcacctgtttcatttctgatattggctatccgtgtcttctttcatttttatttttgttcagtcttgctagagatttgccaattttattgactttgttcaaagagctagcttttgtttcattgatttttctctatcttcctattttaaattttatttatttatattcttatctttattatttccttttctggtgattaggagttattttgttcttttctaatttcttgaggaaaaaacttagtgtgttgattggaggccttttttatttttggtgtaagcagttcgtgctataaattttcttttcagagctgcttttttttatcccataaattttaatatattgtattttcatttcctttcatttgtatttttaaaatttttttgatgctttcttaatgacccatgcattatatagaagtccttttttaaatgttccaaatgtttggagattttcctgttgcctatccattgttgatttttatttttattgyattattggcaaataaggtattctgtatgaccttggttttttttcatttggttgaaatttgttttatgacctaggatatcatctattttggtgtatgttccatgtgtccttgaaaaggatgtacattctgctgttgctacctggagtattctgtgtgttcattagatactatcagtcagtagtgctagtgtttagttcttctgtaactttgcagagtttctatcaattgctgaaactacgtgttaaagtctcaactataattgtgtattgtctatttcttttttcagttaaatcagtttttgcttcatgtattttgaagttctattgtttgatttcttatttatagcacattgttggattatgttttttaatacagtttggcaatatccgtcctctgatttagaccatttataccgaaagtaattattgatatgtcagtgcttaaattggccatcttattgtgtgttttctgttttttctttgtttcccattcatgtatttctcttttcttgccttcctgtggattatttgaataatttttagaattccattttgatttatttatagtgttttttattgaatagttttcttaatggtttctctacttattgcaatatacatatggaacttatcgcagcctggctattgcaatatacatacagaacrtatcaacattttaccattttgagtcaagtgtagaaatcttactttcatttatgttctttagccttctccactttttaaatataattgtcattttctattacattcactgaacaccacatcaggtggtataatttttgtgttaaaaatcaaatgtgatttttaaaactcatgaggagaaggatgctgtagtatatatccctatttttacttgttctattattctctttcttttttgaaattctagtttactatatcatttcctttctgttaggggaacctcctctagtcattctttaaagttagttctgccagtaaaagattctcttcatttctcttcctctgagagtgtctttatttcttgtccattcccacagtgtatttttattggcaatataattcctggttgacaattcttctttttcagaacacaaaataagctgtaccacttacatctgttctccatagtttctgatgagaaactttctgtcattcaaattggtattcctggccaggcacagtggctcatgcctgtaatcccagcattttgggaggctgaggtgggyggatctcttgaggtcaggaattcragaccagcctggacatcatagtgaaaccctgtctctactaaaaatataaaaattagccgggcatggtggcgtgcacctgtaatcacaactacttgggaggctgaggsacaagaatcacctgaacccaggagatggaggttgargcgagcagagatcatgccagtacactccagcctgggcgacagagtgagataccatctcaaaaaaaaaaaaaaaagtattcctttataagtaatgtgccatttgtctctggctgctttctagatttttcctttttccttagatgtttaattttctctgcctttttatgttttcaatgttttagttatgatgtgtcttgatatggatttctttgagtttatcatgtttgcgattttggcagtttctttaatctgtaggtttagatcttccacgaaattagggaaatttttagccattatttctttgaatattttttaagcctcacactttttctaggaattaaatgatatgaattgtaggtgttttgttactggcccacaggtctctgaggctctgttcatgtgtgtttgtttgttttcccagctgattttctgtttttcagacgtgtaatttctattgttctatcatcgagttaactgattctttcctctgtcacatctattacactattcagctcatctaccaagtcttttttctttcattggtatttttttagttctatagtttccatttggttctttttttatatgttgtactattttggtgagcttttaaaaaatttgtttcaagaatagttttaattgctcactaaggcattttgttacagctgctttaaaattcttgtggaatagttttaacatctgtgtcatctcaatgctggtatctcttgattgtctcctctcatctgagttgtgattttctctattctttgtatgatgggtgattttccattatataatggatgtttygtatagtatgttaggagattctgagtcctatttaaaacttctattttagtagacagtcacagagtcacacagtttaggtttattatgtaggttctggcctacttgtgtgggctatggtacaatgacaatttagttttcagagccctgtccacgttattttgatccactttgtttacctggtgccattagttcttgctggtcccctgctggtccttcctgcaaggcagaaggcacgttccagtactgcctggtgctatcaggtaggaagtgagatacatcaggcccaaagggaagacattacttctctgggtctgctcaccaggcagcccagtgctagggtagagtgaggacacctgctcaatgtccactagtgttatagcacgggaggaggacaccctaccagcactgcctgctaccccaggaggtggcagacctggaggaggacaccctaccagcactgcctgctaccccaggaggtggcagacctggaaagactagaatttgtgtgcaggctttttttcttcactgggatcttttacagacttgaaaaattatttttatttccctcctgagctatgttttcattgtgggccagacaatagagctgtcaaatttctgaaacctgcttgcctaaaatctttgcccatactcatcaaggtttactccagggaagcccatttttatttactagcagctgtttttatcctctcatgtcaagcagctcttcctctttggtcaaacctgatccagaataggtgttttctttatagtttcttctaccctctaagagatgaaatgaacagtgtagaggctaaagacttcatcagaccctccattttgtacagaatgagttatataggtctacaggctcaacattcccagtttctaaaatactttgcctctatgccaggtggtagctctgaatttaaaaagcattctgggcctggatggctatccatgaactactgtcacagtattaccataccttattttttctcattgtatccttactcacatgccttccaccacgctctgaccatatggtttcaaaatatctgtattttccatgcttgctccagcctctgacttctgtaatacctgtgtctctgaagcacaatttacctttccattcccatgatgtttgtttcataaaatttagtgctgtccaaaaacagtgctgtccatgacactgtatttgccaatttgccatccaccacctcgtgttaaatgtgaggctcccctcgtgtgttatttgtcttcatcatgacggttgcatgaatacctgaggccctgagttgcattcctgatgttctttcaacamttctaactctgcacatgttcagcacccaaacctctgtagccactcattcattcatctattcagtcatcatcttcccagcatgttgtgtgccagataccacgttggtgctggaatacagctcaaagagcttccaggccatttggggagacagagacaaaaacacaatccagggtgatcagtgctatggcagagagaaacagagtgatgtgggagagccaaggggggttccacccagcccagaggaaccagagaaggtgtcctgaagcaggacgggctctactgaacttccgaaggatgagcagaaattagtcttgtgaaagggaaggaggagagccagtattcaggggacacacattgccccaagtcagaagaatgccaccagttgtcatctggcctggccattggtcaggatccatgtggaggtgtgacatggaaytgcagccataggagagctggccagacgggcttcaggtgccaggttgggagcagtgagcccccactgaagggctgagagcagggaatgacttgggcaggttatgtgttgtggggctcactcaggctgctgtgtgagcctggattctggggggtagggtgcagaggagacggggcactccatgytaaactgagtataatcgagtaccactagctaaacaaccaacccaccaacaaaaccactcctctctgtgctgccagagctacccctagaccattgttcatctgggcatttctcaagcaggggtccctgctgtgcgggggttggaaggaatatcagcagggtaaacacaggagctgcaggtgataggaaaagatctgaggtttaagtgcatctgtcacaatagttaaaacycacctgcccctatcacaaaagcaaacatggttgggcacacattcccttgggctccttcattattgtctgtttccctttcagatgtgcccttggggcccatttcaactggatctttcctaggggcagtggtcagtgcaggctagtgaggcaagctcaggccttgaagctagaccaacctggggtcatatgcctgctgtgtcacctgccaccttaactttttaaccccagctctctcctctgtaaaggagtgtaaccatgcctaccttkcagggttgctgcaatggttagagatgatgttggtaaatgcctggtgtggaataggtgctcatttaatgtgagcagtaggaactgcagggccttctgcagtctggggccctccctttaatacccctaaacaagacagagtaacagctgacgaaagactagagtcaggacttccaggcaagaaatattacagcctcttttgtaatstcgcaaactggaaacagctcattaaaagggaaatgttagcatgaactgtggcttttgtctctaaggartattaggcagctaatctctctctacaaagaaaactaggaaaatgtccacgaaaatctttcactgtgaaaagcaatgtgtggtattttatgtactatgatatcatttgtaagattaaaagaaaaaaaggctttctcagactatatgggtttgtaggatttctggacaggagggatgggaggaagaccacaccccagagtgctaatagagattatctcatygggttaggaccttagggggttgagggatgattattaacccttgtcatgccctgtacattatttgataaaatatatcaagcatgttttacttttataatttacaaatcttaaggaaaaaaaagacctagacatgaattccagatctgcttcttataacctaataagttatttaatttctccaagtctcactacttgtttgccaaatgggaacaaccctcctcctcccagagttttgaaatttaaacacattaattcataatttattccacaaacagagattgagaacccaacagggccaggcaccatgctggggcttcaccagtgaacaaggttgatatgacaccttttccagcaaatgatatatggcacagatgtttatttgcccagccacacagatgagtgaccaacagtggcaatttttgctttgtggcaagaaagaggattgggggatgatttgggagtcatgagcttttggtgtctttcccagctgacctcacagggtgccccctgctcacatggagtagggcctggagcaggcarggacttcctgtgctgtgttctctgcagcagcctccttcctcctggcttgtgtttcagttccaaagcccaagaggagaaatggggtgaacttctccctagctgtggtggtcatctacctgatcctgctcaccgctggcgctgggctgctggtggtccaaggtaaagcaggcttggtcctgtgtagtccctcctggggggagaggggtgacccagctgggcccctcagatgaagggctcaggttgagtggagagcctcgggccactgctcccatctgctgggagacagtctcagcccctggcagccacagtgatgagaggagcaaagaaggagtgtatgttgtgtgtatgtgtgcctgagggagggagagagagagacattgagaatgctcttgtgagcctatgtgtctaagcagtgaaagacatcataatttcacacgggggatgacacacacwtctgacatctaagactcccagcctctgagtgggaagggctttgctgatccaagtgtccatttgaacatgattttacttttgaagtattcccaatctaaaggttaaagtcatgaagtcgttccatgagcagacactgaagtcactcaagaaygctgaatgagcagttgtcataaacacgtcttgtgtgtattaagatcacacacgaatgctgcttgcacatatttaggtcagaccagcatgttagctgtcatgcatctacacccagagcatgcaggaaggtcttaactgcctgaaggttggagattgattgtggatgcagtaggcacagctttaggccacgcagaaatgttttgtggacgtgcaatatcatgcctgagtgtggagcgcacatggtcaagatgtagaaaaggccgtgtgcycacgctaggtcctgacagcacatggaatttgtgtttacaaattcagggcctgtagaagttatgcacacatgacacaagaatgtcagggatatgctcaaatgcctcagtccctaaaagaatgctgtggggtggggcccagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccaggtttggcctcctcccctctgggtcaggacttctcaacagaggtctgggagacagcgggatcaggaaccaggaaattaaggaccctgtccaagcaaagtgtgacctccaagagccagggacttagagcaaccagctcaatgccaagtctgaacccagagtccccacatggatccagaatgtctgggagggagggtaaaacacagagcctggggcggttccctggaccactcccccacagctgacttacactgacatgaggttggggagagagcaactgaaggcaccaaactagttcagacaatgtggggactttgtggggaggaggacacccggacctgctgggggaaaggtggtgacttgggtggtagggctgcaggctggggaaaattgagccaagggttaaaaccccaagggtgccccttccctcggtgctctcagggccttgcagctgcaccctctcctctctcagcctgccccaaaatgggaagagcctcgccctcagacagtttcagcaaaaccagctgctaggtgtggctcaactgttgtagggtttacccygtgacacagagctccagccccagcagggttccttgctctgggccctgtgtgagctgaggcttaggagggtgatcccatgrctaggtcctgtgaccaaggggtacgcccagcacgggacccaggaggccaatccctccagaggctgtggcctccccagggagaaaagacgaaggctgagtgggggtgtgaggaggggcgatagctgtgggcagatggaaggagtccacgttcagacacagacaccatgggagtgtctcttccttccttgaaatgtgaaggagctcattttgaccaatacgaaggggttctacctcctcaggctggtttgaagcaacctcctttccccacctccaagactcccagggatctacaggtctcggggtgcagtccgctagttgcagctragcatctggctctttccaaggactctttcccaaaaaacagccaggtgcttggctcctgttgtccaaacccccacagtctgatgggagccccacacaggagggcttaccctcccactgcagaacctgggcactctcagttggggcttgggccaagggtaccccacagctcagctgcagctcactctccttcccttgcagggatgttcagaatcaaaggtgaacaaggcgccccaggtaggttcatttccactcacacccaccctgctctttccccaaaacctccccaaaagggcccyttggcctgtgccattctgggtctggacagctgaccctagcttaccttcccctgtctccacagcctcctttgtcttcagttgggtctcctctctgttcccagaacttaactggactcccagaccctgggctgtcatccccctccttacttaaagaggcttcctctctccactcccccatccaaatctagctaccttcccaggccagaccaggcatcatctggctgccagggcagcctctctcctggtttcctrtaagcattccttccaggtgactcttacctaccacatacatagcacttcccaccagaggtgctgtgctcatttccatggtgtctcactcctctctcctacagggcagtaatgatgggaggcaggtgtcatggaggcgcaggctgtgcggtcaggccgatctgagttctaatcctgggcctggggcttactggcggtgtgactctgggtcagttacttaagttttctggagccccagccactcacctgtgtaggaagcagtggagataatcgactcgcctcacagagttgctgtaggactcaagggagtgcaaaagctgtctgacaatggcatgtgctctctgaggacaaggctatggttgtttgccttttcttcctgcctcaacccacatgtgttgtgttacacacacgcttcactcacagccctgttccatttcatcwgctgagtggttgaaatttccccctgaggataaatatacatgccatttttgggacagaatcctttggtcccataatatttcaaggatggcccagatcacaccattggccagggagggttttgaggcagccttgcaaagtgatggaagcagggacttgggagactggtgggcctacagaaaatcctggatctgcccctgtaaactgggtggccttgagtaagtcacctaacatttctgagctctatgtcctcccccgtaagatggagatatggtaggacttcctaggattggtgtcaggataaaacaataaatgtacacctcttagtccagtgtccagcaaagagcaagtactcaatgatgttcttgtcttcgttattattatgactattatttgctattgttatatatggttgttattctgttattcttgagaaaactaaatgctgctgctaggagagcctccagcctgatgaatgctggctcctctcctttaaggaggggcagtttcaacaatttcaattgcttttgctgacagaatcaatgcttaaacttcttctcaacccaatgggttcagtacaaccttcaaaatctgcctgtcacccgccctaggcacagtgctgcccacctcaccccagagcacagaacatggcttctatggctctctctctctstgtatgaatatagatgtgcgtacatagaggaaaactccaactctctctctccatgtctctctctctgtctctctgaatatagatgtatgtacatagagaaaaactccaactctctctctccatgtctctctctctgtctctctgaatatagatgtatgtacatagagaaaaactccgactctctccatgtctctctctctgtctctctgaatatagatgtatgtacacagagaaaaactccaactctctctctccatgtctctctctctgtctctctgaatatagatgtatgtacatagagaaaaactccaactatctctctccatgtctccctctctctctctctgaatatagatgtatgtacatagagaaaatctccaactctcactctccrtgtctttctcagtctctctctgtctctgacttctgtctctctctctctctctctgtctcttcccactctttctttttgtgcccagaaaccagagacaggaaacttcttccagcagctggggctatagaagtctcggctcctcctcggacaccacctgcctctccagattccccgcccatcaccctttcccacccagggaggctgtgttctctccccttccccatggcttgccttgcctggtcaagacttcccagaggttccyttgttgaaaaggctccagagacaaataggtgggtgggggaggagggctgggtgtggaacccagaagtcatggtctcactggaggcagcctgccggtggaactgccttcccacgcaggctgcctggaacacagtcaggggaactgctcctcagccaagcttcagggaaggggattgcgaaacccacttgcctctctgtttctctcccctatccatcctggacttctttccttcctcccaacaaatacctattgaaagttccatgaggatgagaagtcgcataggcactggggatccagayatgaagaagacagacaaggccctgcccttgtgagccttcctgtgagcttgccttgtgtgttttccatgatggtccccacgtggtaatctcaggacatccctgtgtaattagtacactaattccatcttactgatgagggagctgaggctcaaaatgatgatgtaacttgcayaaggtcacccagctaaaggggcagtgctaacacctgctcctaggactgtgactcagtgtctctcttttgctttctaggccatgggtttcttgcaggaggagctctgtcttctttccttctttccacacagttggctcatccccatgctcagtgaacgtttgttgaatgaatcaccatgtaagtgattgcatggcgttgttgccccatcctgttgactgactcattagtgtctctgttcctcttcctcaggtcttcaaggtcacaagggggccatgggcatgcctggtgcccctggcccgccgggaccacctgctgagaagggagccaagggggctatgggacgagatggagcaacaggtacgggtctttttcttctgaccctyaatcattttcctcctccttctctggcttcactctgaattccctttcccttccaggcccctcgggaccccaaggcccaccgggagtcaagggagaggcgggtgagtaggtgctgggtatgtacccagaaatacacagcaagtttctcagagtgactgctgtgggctgcagacgcagcctccctccagagtctggacctctgaggggtctgtaggtgaacggaggcctggtgggagaccccagaggkgatgagaggctgggaagcaccctttctggtggccagagtagggctgggcagccgccctcaggggcaggtatggctagatggccttcatcctagatggggctggggggtgtgactcctaccccctcctctgtgtgagaatgtaagtctgccagtgccactttggaaagttggcctccttggtccaacaaggactctggtgtcaggcacatgcacctccaccttggactagctctgtgcccttgggaatgtttcctgatgttcccaaagaaaccgagcctcagtttctttttctgtgattggggatgagagggctgcagagggctgccagggggattagagacaatgacacaaagctcatgatcgttgcttggaaagtattagtttccatttttttagactgttgcctaattctgcccagccatcttattaatataaatgggttcacggggcccggtcagagaatggggggcccagagctgtccctccccagggacaaacccaaacatcagttttccattccactctgctcccatccacccttaatttagaaactccaacttgcaaattccgcaaggggttgaggctgctgggatgtgaagatgcgaagacattaagacctttactagacaaagggcagatgagaggatttacaagggagtgkggagtaaacaaagcaggtctctaagccgccaggctgctgaggcagaaagaaaacaccaccagttacaakaaaggaaacttgttaggaggkagaatcctccagaaattgattttgggaaggaatttaatagaagggaccccaaagagcctattgatctgtgtccagcagggggttttctgaggagggtttaagcggggaggataggcagaccagaagaaggaaggtttatggtgcagtcagaggtgtgcacatgcattcacaccacacacactcacactcatgtctgagggcacatctgtgcacatacttgcattctcacactcactcaygcaccaatgtaatcacactcatgcacacacatgcactcacatacacacatatactcatgcacatatatgcactcacatacacgcatatactcatgcacacccgtgtctgagcacacatctatgtacatatttgcattcttacacttgcacaagtacaatcacacttgtgcacatatgcatatgctcacacacatttgcagacattcgcaccccccatgcacacacactcacactcagcctgtgggggcttgagcagagcaggctcactcagaggggagtgggtctccctccatcctctttcctccgagagrgagggactcaggctagktgactgaaactcaccagagtggagccactgaggctggcttgaagggaaaagccagaagcctgaggagcacagtcatttccttcaagaaggaatagagctggagcctccccttctctttaggactctgacaggtaggcacatcacacagccttgacagagggctcagagcaggactgtgcaaccactagcactaaaaccaggcaacccctttttcagcccaaatcatctggaacccacatacatgaaacagatccacaaagtaggctgttgtggttccatagagagtgtggagtccagagcccatctgcactttctgcttgggccccactggcatcctcaggaaaagcttgtgtaattcagcaactcacttagagcctctctatatacacccacctcctctcactcctctccttcccatccttttccactttgcctcctggatccctcaatttcccctcatagtctcaccatttctctcctcaacagatccctccctgcccctgcccctgccccaggaacacccagcacctccagtctgtactccatatgctagccttggatacctgggccatgtgggtgggaatcaccgtttctcaattccaattttgtcttagaacactaattatgcatctgctgaggacaggtagtcattagcagccccattttacagatgagaaaattcagatgcagaatacttaagtgacttttccaaagttatcagcctggggagtgacagagctacaattcaaacacacttgcctgactctaaagcctttcctgcactgccatgcaggacatattcctaggtgctgttctggacctttgggaagagagctgtcttagcctgttttgtgtcactactacagaatacctgagactgggtaatttacacagaatagaggtttacttagctcatgattctgcaggctgggaagttcaagattgggcagctatctctggcagcttctggtgagggccttgtgttgagtcaaaatgtggtggagaaatggaactagctctcttggtaactaatctagtctcacaagagcaggaactcactccatcttgccagatgggattaatctcttcataagagatctgtctttgtgacycaaacacctccccactaggacctgctgcattaaggaccaggcttccaatgcatgaacttttgagggacactttcatgccatagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattttagacattctcaggccacagcaactgagctcttttttccttcctcacaggcctccaaggaccccagggtgctccagggaagcaaggagccactggtaacttgtacttgctctgctagggacaaatgatgcatagcctgaggcactgaggcagttcccccccaccccccatcctctttccacagccccaccccagcccctgacagttactgcccaccctacagtcctcttctcttgagtcctgtcacatttcttyaagaccacccaagaaatgagctagcacatcccccagaggaaatctggggatcccattcccttctctcccaaatgcttcctgcccctttgcctctggtagcctgtccccaaaaggatagtgggagcccatctcaccagccattctctttgcaggcaccccaggaccccaaggagagaagggcagcaaaggcgatgggggtctcattggcccaaaaggggaaactggaactaagggagagaaaggagacctgggtctcccaggtgagggccgtattgggggtgtcggtgcttgccaggaggcctgagggaactagggcctgacctctgtgccattgggtctattcagtgcccactgagggcaaggcagtgctctgtctatgggaatctctggagcaccacacatagtctcttctttccgggtgagcaaagagatgcaatatgagagggagaacaatgtcattccaggcatgactatggcaagctggggcacaggyagtgctaggagctcagagaggaagccaaggggatgaggagrgtgggcctgcactgggccttgggaagcagggcagactgactggtggcaagggcaaggggattgattcaaggagggagaccccaggcagccagaatcccccattgactgagggtgctatctctagaacagtgttcctcaagccaagggccaatatcataagagctgtttgggtgcttgcttaaaatgcagggagggctcgagggtctgtttcaaatgccctggatggttctgaccatgaaggtctgtgcaccacactcgaagaaacactggcttatgggctctggacttgactgagcatgccacgctctccgcctctcagcctcctgcagtcattggggaggctctgcagtgaatggcagagagtgaggattgcggggccaggcgggcttggttcccatccctgctctgcacctgctcccctgtgtgactaacgcaatacttcacccttctgagctttaatgttctcattttagaaaagaatggtaattaagttaaaaaataattaaattagatatattttacaagacagtaataakggttagagaccatgttttcaagctgtctgcaacatgataggcattaaatacatgacaactagtaataggcattaaatatgtgatagctagtaatagtaatagtattagtaataataatagtagtagtagttatcctgtaacgtagaaagggaaggacttcagtttcaagatcagacagacctgggttctgatatggctcactaactgtgtgaccttgggcaaatgaattaacctctcttagcctcaatttactctcctagaaaagggagctaataataatacaaacctttaatgaggatgaattactgcaggaatataagacatatgagatgtgtaccactgtacctggcacatgggaattccttacaaaaaaactgggaagccttgccctcaagaagacagcccttagtagggatgtgtcagccatcctcaaatattcaaagggcatttgtgggaaagaaaatggtcttgcccagggtggtacccagcagaagaacaaggaccaatggactaaggtttcaggaggaccaattgtgctaaggcaagggaggaagaatgattcagaacctggggctgacccatgatgaagtgcgtgggcatgggttttagcgggaagctgactgctgggaggggaggaggggctrcagaattctcctaggctggtctgatgagggatactggcaccaggaacatggttgggtggttgacctctgaggatccttccaaagctggaacaacacagttctctttatagatgggaaagggagacccagactttctcaaggtggtcctgccagccccagagaaggggcctcagccaggtctttgcccactgagtctgagttatgcagcttcccaaccacactgtcacaaaggcacgcatagaatccacacccagactcaggcttggaaacgctgtggttggcgaagggaaaggcagcagtttgagttcttcaaaaatcaggactcaggcccacccctcctcttcccaaatttcctctcccaagatcatgaggtctctcttacccatggcttgctcaatccactgctggtggctgggctgtgcaaaccaagagagacctgaccccartagtgctgagattttacctattctcttcctgctagtagacagataagccaccaacttaaagtcccaggggataagcctattttcctcactctactacttagctacagttgggaagttctgaagtcaggcagctgtgcttccttggctagagccagagtgtggtcctctgactgatgtgatactgccctcttcccaaagccattccctttgctggggagtggaagttatagcaacacagatgcaggtccagaccattctgaagaaacttcatgtggcccagcaatgctgtaacttgatggtcctggcccacagcaaaaaaggcaccaacagattcctccagggaaacagttctcagtgccttctaacaggtgccgttggccccttctccagggtggacactctgaayggccaagaacagcctcctctgctttttgcatctccagctgttataggacgcctcagccataaccaagttccttaggattgctttgtcttcctcaaggagcagccacccttcaagtattcagccatctcaaggggtctgattcatgagcctcatacctcgtgaattcacagcactcaatgctaagacccagggctctcccttcttcctcacctcttcagagctctctctccccttttctaattcactggagagaargctggtgtcatgcctgagtcctccccagcttcagaattatcaaaatcatagawtggagcaataaatgccttttagcaaaattgcatcccaataagcctttttgaaagcctaaaabgttgtgttgaggtgagatattcctctttagacctttgccccactctacccacccccaggggagtggarttgagcacggacacccagctgatggtgggaccttggcagcctaccagtagtaccctgcattgcatggctggcaaggtccaggcagtccacccctaaaccaaagaagtcacagagccctaccccagtgaggagcctctgtcaattgatatgcaccaggcaccagcaagagaggagggagcgacagaggactcagaaggggacaggctaggatgagctctgaattctgatgataagtggaaaatttgaaatcttgggtaccaggaaagcccatgtctgaagtgctggcaggaatatgagctgctgcagtgtttttctctctattgatgcctcagagttgctattctcagcatttgggatctgcttttcggaatactcaggtttcaatttttgaagtgaattcaaataattgccaaaatgcagacactaaaacaagccagacagtgctggctgagccttggctattgtccctcccaaggggaccarggctttctgttgactgtcagccataccagatcacctcaccaaattttcatgagtttctttcttgtctctggggcaaagcggtgcactccttgagggcagcggtcatatcttccactcgcgggcaccaagtaggagctcaaggagtttagggtttgggatttcagtggaatgggaagtgtcagaggaggacatggtggcctgattggagttcctcccacaactaaccaagactttttggtttttcaggaagcaaaggggacaggggcatgaaaggagatgcaggggtcatggggcctcctggagcccaggggagtaaaggtgactycgggaggccaggcccaccaggtaagagggcacgtggtcacatccactgacctctaggtatttccttttttttttttttctggctggctgagccaaaggaaaaaaaaattcctaaaagtyctttttcatcttaggtttggctggttttcctggagctaaaggagatcaaggtaagaactacaggaatctgggcatcatcccagctaygactgtccctggcagagtgaagctggggaccagacaccaccatcttttgcttcattgtagtattcacccagaacacctggggttttttagacatctggccctggccaagaggaacagagcagccagtgggcggtgggggcaggcctcactgatgtttctctctagactttaccccactttgccacccagggggtggagttggacagtcacacccagagctcctagtaagtccataagtcccaggccctgcagatggaaaagattagtaagttgctgagaataattttcctcctactaagagggctagctcatggcttctaaagagaggtgttaaagctgccaagaggactgtaaggtgttaagaggtacatgtctcactgctgaaaacagaagcactgggggttggggtatctgggccctctgccaaccaccacagcctggcagtcactactttcctttcaggacaacctggactgcagggtgttccgggccctcctggtgcagtgggacacccaggtgccaagggtgagcctggcagtgctggctcycctgggcgagcaggtgaggtcctgggtcctatggtgggcacagggagtgatgtgtgaaaacctgcctagtccagcccttatgctctctgtggtgtctgttgtccaggacttccagggagccccgggagtccaggagccacaggcctgaaaggaagcaaaggggacacaggtaacagagggtgcagtgggtgagtaggtgggcttgctgggtggcaggatggatggagagaaaaactgcttcttcttaggcycacggaggaggcagagggtcttctgtgccttggcctctgaggttcctggttatgggggcagttgcccctgccaggaccccttaagcccaagggcctagggctgttctttctcttctcagagctcatgaaagtccttgaatgccatgaccaaacctccagcatcacggaggagagcaaagcaccttgcccataccatctccctggtctgcctcccagctgtaygtttctgctgtctcctgctaacccttcattggggcccctaagagggggtccaagagtctagattcaggctggagggtccagaaaactcttcttccacattttcctaggggggcagcctgggagcactgacccacactagccaaagactagtttataccataatgccaacagagtctaggttagtctaggttatataccatcatgtctatttagtctaggtcgtaaaccattgtaccaatatagtctactttataagccgttttggtccagtcacagtgtgcttgcttggtctagaaagtccagaccactatcacaatgcataagatcaattcctgcctttctgccctgacatgcagggtattgcagtgaacagagactgttgccagatgatgtgggcacactctgattgggcatttctgtggagaactgttgcacattggaaagccaagagygggcaggaggggcaatggggaaggcagggttgtgatgtaaagctgcatgtctgccaaggacatctgtagacagtctgcctccacccctgtcctctgcctgagaaggtcacgcttgtgtcagacaacctggatgccctcacccccgtgctgtgctagagacctacactgggacctggccctccacagctctaatcaattgattgattcattcatcaccacctcctggcaaaccttgggctctgggcttgagcttttgtgtttytttgaaagctgtcgggagccatggcaagcgcagttttacaccctctctgtccttgtaatctgtcsagccccagagcaattgtgttttttatggacagtgtgtttgggaggatccctgctacctgatcccatgtggatgccacctgaaggccactagctgggtctcaccataggaaagtttccatctgggtatagtcgtcagatgttcctgacttgttcactgtccattctgatcttataattccatcttctctggtccccagtctcagagtccatctgactatgagacctgatgctctcttgcccctgagccttctgtgtgatttcatggagatgattgctttcatctctcggttgtaaatagtagtcaccctctgcccccacccccactgccagactaacrgttctcaactaaccaagagtattggaggtaaaacatgattttacccacaggagcattgtgcttactccccaagccccaagcttgtgtcttccacagtctgagggtagggaatcctgccctgccctttgcatcctgggaggatttgcagaacaaaagcagctcctgctaatgagcatcttcttgacacccagtgggacaagcactctttgtagcacaactttacggtcaaacagccattaagagatgcagccaggttcaaatctaggccagtacaagacaaagcttgggatcttattagtacagtctatcatgagttctccctccccagccccacaatcagggtgtgctgatgagtgacacctcctcccttcatcccagttcagaaaggatcagagcagaaggtagcagcttgttccattcctgggaagaaacatgaagctttcaggccctatcatggttcttagttatttaaccaggaccccacacccattttagcaaaagacttttggcccatagcttggggatcattttaatttcatcctcrtcgagaccttttatatctgctgaatacccttatggagttctccaataattaggcctagtggtgagtaccagccagcaaattctaggggttacccttaattctggctgaccaagtaaacatgaggaagtgcatttcaatttggggcttgtgataattcccgtttatctaaaactgtgcaggttgcccacccgagtccaaatgttttccttgatttagtagctgacagtccacatggacatctcagaggggaattccaataggaccataatctggctaatttagctgggtatgtagatcatcctggagtcataggctaataaacttccggagagattagatttgacaacttctgaagtgggagaagcaggggcaggcagagggtgggagcccaatctccccatcatggagcacagtgtatacttgtcaatgtcaggatgtcggtattccccaaactaaagccactgcagtgcttggccagtgttgatatatcaagccaggtttccaaactgatgtatttcccattttgtaaataaaatcgttaatctctcaagagaatatctagccactttagatgaaaacagaaaaattacagtgcrttggcttgacctaggtgacagctaggtttcattactgygcattaattattttaaaaacatgagckgtctgttcattattatcagtgcctctgggccaggcactgtgcctgggtcttgactcccatgatcacactgaacttatcattcctactttacaracaaggaagcaaaggctcagagagagtaaaccctttgctcacagtgtcacagggagcatgaactgaattcagaagtgaatcccaaagtctgattccagagttgtgcttttccagaatcggttttatggaagaacgtagagtgtatgatttgagagaaatcrgttaccttcaccctgtccccaccccagccacacctcccactcctccataaatgggtaaatcctggcttggtcaccaagcctttctacctcctccacagccactgaccacactctaccccattcaggtgaaatgcttcctcttgtttgcatctcttgagagaggagccagctcatattaaagaagacaaagaggaaattcttcccattctggtgggaagataacctccacagtttattaagcaaggcaccataccctgcagaaccttctctcagggtcactttttttacctactagaaacagaccctgtccagcctccatcacttagtatttctaacattttcactttcaaagattgcagaagaataatccaattttagctctacatgtcttagctattttgaaataatatttatttagaaataaggaaggactccacttcggcttgtaatcatgacatttctctttttaccatttacacctcatgaaataacattagaagcagccaaaacatttaaactccaaaacaccaatctgattggaaattctttatctcaatggcctttatgtctaaactatagcaatgtgaattttccatgcccttttattttcctcttggggcaaaaccgaagtgcaaataactcaaaatccattttctcatctgtatttgaagatgttttactttaaagataagccaaaaagatcatccataatagcaattgagccctatgtcatgaatataatttcttagttaattccattccttatatctaagttctgagatagtccaataatttattaaattctactaagtcaaatcactaaattgtcatttataaaactcttcctcattttcctctaagtttctgagagagctytgcagaagtctacacataccccaattttgagtcccttatccttcatctcacttcttaccacaaggtcgatttgtcagttattagctcaatcctaaatttgccaggttgcatctagcctccaagttggcatggtatttaggaaagtttccccagacggggcaagacagcaatgtccccctctctacaaaacataaaaaaattagctgggcatagtggcatgtacctgtagtctcagctactcaggtggctgaaggaggaggagaaggatcacttgagccaaagaatttgagcctgcagtgagctatgattgcaccactgcactccagcctgagcaacagagtgagaccctgtcaaaaagaagaaagaaagaaagagagagagagrraggaaggaaggragggagggagggagggaaggaargaagaaagaaagaaagaaagaaagaaagaaagaaagaaagaaagaaagaaagaaagaaagaaagaargaaagaaagaaagaargaaggaargaaggaaggaaagaaagaaagaaagaaagaaagaaagaaagaaaagaaagaaagaaagrgaaagaaagagaaagaaagaagaaagaaagaaaagaaagarygtgagagaaaagaaaagaaagggaaagaaagaaagttttcttaatgtattggagatttctccatttcactcagaatcaggagatctgagcctcagcttgaacttacccctgactagctgagtgaccacaggctcagctacttgacgttgctgagcctgtttccttttctgtggcgtgcaagcagtatagaagaacaccaggtccctgacagtttcacagcactctgggtttgaaataggcagcttccctgggagcaggaacaattgaagactttagtcagaacaccagctcaacactaaacaactggamggcatatgttttctaacttaacacacatttcttgggagaatattatttctgtaaaaacactttgcaagtaaatatttggaaccctttcagcttgataagcttgtgatacttggggaaagccagcttgcttatggttaagaagaaaaatccagcatttatttgctctccagcgtagttttacaacatgcagctctagaacctattttttagccatttctccctctactctgcaggagctgatcctatcaggatgctgccttgatttatagtgaagtaattactagttcctccatcgattagtccatggacaaccactcagccagtgttctcttagagtccagcgaggcttggagagaaatgatacaaacctcaattctaatttccaatacccattaaatacatatcagaaggcatttcatcaaggtccaacctctgctataggaactgtgggtctgggaggrttcagatgcgagaggggctgtgagctcctaaagagacaaggaaggctgctcgtaggaggtgggctgtaagctggtcgctcaagaatgagtgagagttgtttagggcagtgttactcaaaatgtggtcctgagacttgcagcattagcatcacctgggaacttgttagtactgtggattcttggattcccactccagtcccactaaatcagtgactccggtgggacctagcaagttgtttactaacaagatgcacccagatgattctgatgtattctctagtttgactactcctcttttagggggaagaaatggcctcagggaggctggaggtgtcttgggaaccaagtgcgtagaccaagtgaaactccagataggagtgagcctagtactagtggaacaaaggtgccttcagggaacattgggaggctgggcctgggtgacagccccaacttcccccattcactcttatgtgaccttgaattactcacctagcatctcygagtgtgtactttctcctctgtaaaggagggaaatcacactgccttggagggtggctgaaagatcaaacaaggtcatggatgtaaagcccctggcacagtgcctggcgtgatgcaggcagcagaaaatgctgagtcccctggaggtgaggagctaggaagggagagtgtgggaaatgaaragggagagtcaggcttggggctatggacctggtgaacaggggcttccctatgattcctgtctttagagggtgtttgctgctcggtgctttaggggacagttggaggggtgcatctytttaggtggtcacaataaagggtggtcacagtgttttgaggccccttctacttacctgcatgtgaacagcgtatgtcaagactggtggggagaaagaccacaatctatatgtctatgatggtgatgaagcaggaaacagtccacatccagactcttggccccttctatctgcatcccagagggtgccatgttgcagaaatctctaccttaagagcgtgtccctagaggtagggttcagggaccccaagacatagtgacctccctggatgtggactgttttctacttcatcaccatcatagacatacagaatgtgatctttcgcccaacccatcttggcgtatgctgttcagatgcaggtaagcagaagggaaacatctgtcgcttctcctgggcaatctcagctaagcccttcaggtcaatagcagacattttctgggtgctagctgtgcagcaatcctggtgctcatgtgtggactcaacctcagtgcctgaggtgctccccacctggaggggacacaggacactgtgggtcctgttacatcatttattcagcactggctgggcaccgggctcagcgcttgatacacacgatttcatttcagccttacaactgcctcaggaggcaaacaaggagactcagagaaggaaactgaggctcagagcagggacacctggctcaaggtcacaaagttagtataagacagaagtggactcaagtccgggctgtcagactttggaaccactttgctttactgccttgggagaaaggatatcttgtcttgggcgagggagagaaggcttcacaggtggtgacatctgacatctttgcagagtttacaagctaaatgtgagttctccaggtgaaccaaagcagtgaggcattctattcagagggacaggtgtgtgcacaaatggccctgtgtaagctggggcctgtctgccaggggctgacctctaaggcacctccagctcttacaaaaacctatcccaacctcagttctgtccctttccctaacacgaggaacagaagtagctgccctctcagaatcttctggtgcttcctgcttctcttgttgcctgggtctgcagcggcagctcccagccccttagctctccagccctcctccccaggcagcaccaggcctggaggtgggatctgaaatgcccccagagtcacaacttctcttgctcgttattccaagaaggggccctgaagaggtctgccagccccttgcctctccctccactgaccagcacactgcaggtgcttgggaaatccagggattgaagtgagaggtggggcagggcaggcagaaacttccccgaggcaactgcaaggaggttgactgagctccatgcttggctggggacacagatacttatgactcactgttggtgttcccctcattaccctctagtaactgttattgatagtcaataatgagcttgcattttcccaagtttgtgtaactgccttgaggagtcctatttctctgaaataaaataaatattggcacttaaaatcaagaggacatgatcttgctaaatgaacaaattattatctcagtgacccagcargwtgctggggacagtgggccttccatgaaagtttactgaaaaaaaaggatgaatggatggaaagaaggaagaaagggggacctttaacattaactacaataggatcatcatcaatgactgtggttattatttttccattttctggacattagaccctttagccacatgaatctttagccactgggagccacaatgaaaaaaaccaacaaatacttgaagagcatctactatgcaggaggacctccaaagctcctggtggccactgagcccctccacagtcttttagcaataaagataactttatttaccaaatatctcccaattctcttccaatataaatgcaacagcagggaatgggattggatttagatgccaggtcaggttaccggggggcagggaaggccagtggtgcatctggggtctgtctaatccaggctttcatccagtactttgccgtttcacccccaacacacctgttctcattcatctgcagactgtctcttttcatgatctgctgaagaggctttaaacaatcgtggagaaccaatgtatctttccatctgcattaatcagacaaaaggtagaggttgtctaagattaaaaatgtctaatacctaagttttattatctcctccccccccccttttttgttttgatcttaggacttcaaggacagcaaggaagaaaaggagaatcaggagttccaggtaaagggcaggctgcatcttcatccctcggagtgatgacggggaaggcctgccttctcagagggcaggtcttgttgacattgaatgcacagctgtgaccttctcccaaagtggaggttaagactccagggctctgtcactcaagcctcagatttctccgctgcaaaacctgggaaccacaggaactcaacatcctgaggggtgtagcgtatggggcaggggctgaggatggcaaaggggctgaggatggcaaaggggaaaaatgtcaggagagctgggggtgcaggcagaggctccaggctctacagccgccatggagctgtgccccttctgctccatccacggctgctgcttccccacctcagctgtggcccacttgtctcttcttggcccccaagcttctcctctctgcctcctgctgcctgtcactgggctttcttattcttatcctcacctccagagcctgtgcttcagttgggtactgagctggcaccagctggacggtgtttctaggcctctcaagagccctgcccctgtgagtgcaaaagtgagatttttcagacacatttcttgagcaagttttcttyctcataagctagatattctattatgttttatggttttttttttttttcaatttttttagagacaaattctctgtgtcacccaggcccgaatgcagtggtgccaggacaggatagctcactgtagccttggcctcccgggatcaagtgatcctcccaccttcgtctcccaaagcttgggattacaggagtaagccactgtactcggcctctgttactatttcaattcactaaaggagacatcgaggcttagaaacattctagcaaattctcccagcatggctagaacttccacataactatgtaattccagaaggaccaagaatctgtggaataccaccagctattttagcctgcctgttctcgacagcatttacctaagagttgagagatcagtgcagcccccagatgraccaaagacaggctgaacattcagatagcccagccatgggggaggtctggcagttaaggataactcatttattaaacagtaatgcccttgggtctctcttgggaaggcaaagcagggcacctgatcagggcagtgtctctccttccaggccctgcaggtgtgaagggagaacaggggagcccagggctggcaggtcccaagggagcccctggacaagctggccagaagggagaccagggagtgaaaggtaaggcctctgcatctgattccttkgttcttaggactgtrctttacagccagttctgtaccttaaaataggaaaggcgctgttttaagagttctggggattttcagaacccaggagggtagaggtttatttcctygattgacaagtcttgtgctggggyttgccctaggcatggagcacacagcagcgggttaggcgcagctctagcatccaaggcaggggcgtgaacatgcacttgagccatgccccacgacccaacactcctaggcagtttccatgaaggagatgagcccatcccactccatatctctgaccagaccaagcatccctcaccaatctaacttcaacccctcttgctgtagctcaggcccgtttcttcctgctcagtcattgacacccgcaggacrtcccatccccataatgccaggccacaggcgagacccacggagcatctgaccactcccaaccctccacccrctccccactcatgcaaatgcaggcaaaggcgtcctgcctgggtttctttcaaaccgtgtgggttttctcctcatgacaggatcttctggggagcaaggagtaaagggagaaaaaggtgaaagaggtaatcactatttatattatctttaatgtgtgctttaaagtcaattctgcacctgaaaattgtgtgtgttgggggaagagaccttggttctcaaataaatttctcattttggggaggagttgagggtctagtcccttgaatgagcctgcccacggcacagagcagcagtttctctccccagccactctctcccttccttccttctctcccttccttccccctttctccttcttcctttccttttctctctccctccctcccttcctcccctttcccttcwttctttcctctccatccctccttcctttccctctctctctccattctttccttccttccttctcttttctcagctttcctttttttctctccacaacacatgacaagacgtggtgtatgcgatttgcaaaccagccacaggggcacctgcccctgtggccttgtgcctgcaggccccaggtgcatggaggctgcgtgccaggttgggttggcactgtaaagtgggatcttccaggctctggtgacagtcaagcaggggcatttcttttccttaactgtagaactccaaaatgaaaagaaagagcccrcacttacccaaagccccaaggggycttccttgcctctcccatgtgtgtttcttcacccaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggtaagtgagtcatcagccgggggcctcttccccagaggtgtggatgtggctttctctcgctggtggggtgttggcaagtgactcagtgtggttttctttaaaagaaaaatattggtccaagcaaccaaaaagctctgcagtgcagggctccaggtatgcatccttccagcttggcaaccccagcagaaagatggcctgtcttctccagcgctgacagtgaaggctggcctggcttcggtcaaggtccatccagccctggagtcagaatgccacatggctgagggtgtttgccgcagatggctctccaaaggacagctgagttgatgcaactggaagaacagagagaagattcagggcaggcaaacgcagatgttcactccagctgtctgtgaaccagcagcctggattgaccagcaagcagtcttggctgtgatcatctttaaagagaagaygggaagggaagagaaagcaaatcagagcagggacttactaaaatgtgtggaaaatgtcttcggatgctggagactcagcctatatctttcagccaaaagttcaagccttgagcaaagaagttaagtccccaggcagaacccttttctctggctataggatctggcccagcaggacatgaggccagtttcccttgctcccagccccaagtgctccctgtccttacccaaaccaaagcaaatgcccactttagagcagggcgatggcttgattacagaggcatgtgaggcaggtggacgcagcaggagtgaatttgcagggaggaaactaaaggacacccgcctaggaagatatttcaaatagtgtggggtttaagcattaaagatttgcatgagacttttgtcaaagggtagagaatagaacggaggcaaagtcattataaaaacaacaacaacaacaacaacaacaaaaacaggctaagccagccatcagcacattgggccggaatgggccagaatgagtgagaagtcggcagtcyacctcagatggaagctcccaggcgcacacgtggcttctttgctttgactctaatcctacccttcttcctctgtctcttgctttctctctatcaaggcactgggcagatctggctggataatgttcagtgycggggcacrgagagtaccctgtggagctgcaccaagaatagctggggccatcatgactgcagccacgasgaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattggctgtggctgagtgtcactgtgttcatacctcccatccccattgatgtgcccactccatgcaccacaacatttcattgaattctctcatgtccgtagccaggggaaggagaggttggaggtggtgaggcagaaggtgaaggtcacctatggtcaaccttagtcttgaccatctcttcagtcattcagacataacatctctcatggtgagctctctatccccctttttgtcctcccctgacagtgacctggtaacattccagcacacacatgaactctcttcatgccctatgctgtgtgctccaccctgactccacctgcccaaccggtccttgctctctctcagcgccctgcctgmtgggctaagcccactctccatgttgcaaaccacatagtaagcctgaaatcagtcttagagtctcattgatctttccttccatacatgggtgggatttacagaatggaaatatttatctggagtgacagtaatcaaaaaagttttctgaagaaagcacaatttgaactggaccttaaagggtggggaggatgtgaccccttcttggcatgcagtgactgtcactctaggacctgtaggtataaaaggcttcgttttcctgagcctctcctgtgtcccttcttgtggcaacaactcactaaccatctactgaaagaacaaagaacactaggtatcagcttgtttttttttttaagttttagggtacatgtgcacaacgtgcaggtttgttacatatgtatacatgtgccatgttggtgtgctgcacccattaactcatcatttagcattaggtatatctcctaatgctatccctcccccctccccccaccccacaacagcccctggtgtgtgatgttccccttcctgtgtccatgtgttctcattgttcaattcccacatatgagtgaggacatgtggtgtttggttttttgtccttgcaatagtttgctgagaatgatggtttccagcttcatccatgtccctacaaaggacatgaactcatccttttttatggatgtgtagtattccatggtgtatatgtgccacattttcttaatccagtctattgttgttgcacatttgggttggttccaagtctttgctgttgtgaataatgccacaataaacatatgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctaattctccacatcctctccagcacctgttgtttcctgactttttaatgatcgccattctaactggtgtgagatagtatctcactgtggttttgatttgcatttctctgatggccagtgatgatgagcattttttcatgtgtcttttggctgcataaatgtcttcttttgagaagtgtctgttcatatcctttacctactttttgatggggttgtttgtttttttcttgtaaatttgagttcattgtagattctggatactagccctttgtcagatggttagattgcagaaattttctcccattctgtagcttgccagttcactatgatggtagtttcttttgctgtgcagaagctctttagtttaattagatgccatttgtcaattttggcttttgttgccrttgyttttggtgttttagacatgaagtccttgcccatgcctatgtcctgaatggtattgcctaggttttcttctagggtttttatggttttaggtctaacgtttaagtctttaatccatcttgaattratttttgtataaggtrtaargaagggatccagtttcagctttctacatatggctagccagttttcccagcaaaatttattaatagagaatcctttccccattgcttgtttttctcaggtttgtcaaagatcagatagttgtagatacgcrgcattatttctgagggctctgttctgttccattggtctatatctctgttttggtaccagtaccatgctgttttggttactgtagccttgcagtatagtttgaagtcaggtagcgtgatgcctccaactttgttcttttggcttaggattgacttgacaatgcgggctcttttttggttccacatgaactttaaagtagtttttcccaattctgtgaagaaagtcattggtagcttgatggggatggcattgaatctataaattaccttgggcagtatggctattttcatgatattgattcttcctaaccatgagcatggaatgttcttccatttgtttgtatcctcttttatttccttgagcagtggtttgtagttctccttgaagaggtccttcacatcccttgtaagttggattcctaggtattttattctctttgaagcaattctgaatgggagttcactcatgatttggctctctgtttgtttgttattkgtgtataagaatgcttgtgatttttgtacattgattttktatcctgagactttgctgaagttgcttatcagcttraggagattttgggctgagacaatggggttttctagatatacaatcatgtcgtctgcaaacagggacaatttgacttcctcttttcctatttgaataccctttatttccttcwcctgcctgattgacctggccagaatttccaacactatgttgaataggagtggtgagagagggcaaccctgtcttgtgccagttttcaaagggaatgcttccagtttttgcccattcagtatgatattggctgtgggtttgtcatagatagctcttattattttgagatacatcccattgatacctaatttatcgagagtttttaccatgaggggttcttgaattttgtcraaggccttttctgcatctattgagatattgagataatcgtgtggtttttgtcattggttctgtttatatgctggattacgttaattgatttgcatatgttgaaccagccttgcatcccagggatgaagcccacttcatcatggtggataagctttttgatgtgctgctggattcggtttgccagtattttactgaggatttttgcatcaatgttcatcagggatattggtctaaaattctctttktttgttgtgtctctgccaggctttgttatcaggatgacgatggcctcataaaatgagttagggaggattccctctttttctattgattggaatagtttcagaaggaatggtaccagctcctccttgtacctctggtagaattcagctgtgaatccatctggtcctggactttttttggttggtaagctattaattattgcctcaaattcagagcctgttattggactattcagagattcaacttcttcctggtttagtcttgggagggtgtatgtgtccaggaatttatccatttcttctagattttctagtttatttgtatagaggtgtttatagtattctctaatggtagtttgtatttctgtgggatcggtggtgatatcccctttatcactttttattgcatctatttgattcttctctcttttcttctttactagtcttactagcagtctatcaattttgttaatcttttcaaaaaaccagctcctggattcattgattttttgaagggctttttgtgtctctatttccttcagttctgctctgatcttagttatttcttgccttctgctggcttttgaatgtgtttgctcttgcttctttagttcttttaattgtgatgttagggtgtcagttttagatctttcctgttttctcttgtgggcatttagtgctacaaatttccctctacacactgctttgaatgtgtcccagagattctggtatgttgtgtctttgttcttattsgtttcaaagaacatctttatttctgccttcattttgttatgtayccagtagtcattcaggagcaggttgttcagtttccatgtagttgagggttttttttttttgttaattatactttaagttttagggtacatgtgcacattgtgcaggttagttacatatgtatacatgggccatgctcgtgcgctgcacccattaactcgtcatctagcattaggtatatctcccgatgctatccctccccccttcccgcaccccacaacagtcccagagtgtgatattccccttcctgtgtccatgtgatctcattgttcaattcccacctatgagtgagaatatgtggtgtttggttttttgttcttgagatagtttactgagaatgatgatttccaatttcatccacgtccctacaaaggacatgaactaatcattttttatggctgcatagtattccatggtgtatatgtgccacattttcttaacccagtctatcattgttggacatttgggttggttccaagtctttgctattgtgaataatgccgcactaaacatacgtgtgcatgtgtctttatagcagcatgatttataatcctttgggtatatacccagtaatgggatggckgggtcaaatggtatttccagttctagatccctgaggaattgccacactgacttccacaatggttgaactagtttacagtcccatcaacagtgtaaaagtgttcctgcttctccacatcctctccggcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgggtattagccctttaaggaaatagagacacaaaaacccttcaaaaaattaatgaatccaggagctggtttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccagaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaayaaaaaaagagaattttagaccaatatccttgatgaacattgatgcaaaaatcctcagtaaaatactggcaaaacaaatccagcagcacatcaaaaagcttatccaccatgatcaagkgggcttcatccctgggatgcaaggctggttcaatatacacaaatcaataaatgtaatccagcacataaacagagccaaagacaaaaaccacaggattgtctcaatagatgcagaaaaagcctttgacaaaattcaacaacccttcttgctaaaaactctcaataaattaggtattgatgggacgtatttcaaaataataagagctatctatgactaacccacagccaatatcatactgaatgggcaaaaactggaagcattccctttgaaaactggcacaagacagggatgccctctctcaccactcctattcaacatagtgttggaaattctggccagggcaattaggcaggagaaggaaataaagggtattcaattaggaaaagaggaagtcaaattgtccctgtttgcagacgacatgattgtatatctagaaaaccccattg

SEQ ID NO: 13201 - DNA, 23107 bp, Homo sapiens
gagcagtggtccaagctctatcttggcccgtttgagccaaggctggagccagagcagagtggcctggatgcgggcagcagtgtcccaaagctgtgcatagcagtgtggccctggcctggcccataaaacctctgggcctagtgcaccaaacctctgcacctgtgatgggaggggctgcttcatagatctctgaaatgccctcaaggcctttttaacattgtcttgaatattagcacttggctcccttttagtcatgctaatctctctagcaatgattgctctgcagcctacttggattctttctctgccacaaggccaggctgcaaattttccaaatttttagactctacttccattttaaacataggttccaactttaagtcatttctttacccctgagcacaggctgttagaagcagacaggccatatcctggcttagaaatttctaagcaggccaggcggggtggctcatgcttgtaaccccagcattttgggaggccaaggcgggtggatcacsaggtcagaagattgagaccatcttggctaacatggtgaaacctcgtctctactaaaatactaaaaaattagccaggtatggtggcaggcgcctgtagtcccagctacttgggaggctgaggcaggagaatggcatgaacccaggagacagagcttgaagtgagccaagattgcgccactgcgctccagcctgggcgacacagcaaaactccagctcaaaaaaaaaaaaaaaagaaagaaagaaatttctaagcaacacactttgttgcttagaggtttcttccactagataccctaccgtaagtcatcactcttacattcaaacttccacagatccccaggacatgaacacaatgcacccaatttctttgctgagtcatagcaagggtgacctttgcccagttcccaacaaattccccatttccatctgagactttgtcaccctggacttcattgtccgtatcactatcagcattttggtcacaaccatttagccagtctctaagaagttccaaactttccctcatcttcttgttttcttctgagccctttaaaytcttccaatctttgcccattacccagttccaaagttgactccacatttttagatatctttatagctatatgccccattcttcagtaccarttttctgtattaagccattcttttttttttctttttttcttttttttgagacggagtctcactctgtcgcccaggctggagtgcagtggtgcaatctcggctcactgcaagctccgcttcccgggttcatgccattctcctgcctcagcctccagagtagctgggactacaggcgcccaccaccacgcccgactaattttttgtatttttagtagagatggagtttcaccgtgttagccggtggtctcaatctcctgacctcatgttccacccccctcagcctcccacagtgctgggattacaggcgtgagccaccatgcccagcctgtattaagccaytcttatgttgctataaagaaatatctgaggctgggtaatttatatggaaatgaagtttattttggctcacagttctgcaggctgtacaagcatggcacccacatctgctcagcttttggcgaagccttaggaaactttcaatcatggcagagagcgaaggggagcagggatgtcacatgtcgaaagcagtaacaagagagcaatgggggagtgccacacacttttaaacaaccatatctcaggagaactcattcactattgagaggacagtaccaagctattcatgagggatctgcccccatgatccaaacacctcccaccaggccctacctccaacactggggattacatttcaacatgagatttggagggaacaaatacccagactacatcaatcacccatctccagagaaaaggaaaagggaatttagaaacaaaaaaaaaaagcacatccatcagagaacagatgagctaaggtgaagaggtaattgtagctaaatagaaatttgctgactgaacgtgaagctgtcccttcctgctatggacttcagattttagcccacttgaattgctccatatcctccaagccatggccatcccttgactctctgggctcccaagcacttgctgccttcatcacacagtttgagttaaggcagaaagactggtttccatgtacactttgtggaagctttctcatttctttatataatctctgtcctttgtctactgctttaaaatctagaaattgtttacaaacacaaaggtgatcctttaaaagctcaaagctgattgtgtcaccaatatataccactcttaatggcttcccattaaactttgagtaaagactttatggagcctacataaggccatgactacctggctcttattttcctcctcatcctcatctcaccaactcactctccactcctatacccctcactccttccccctcctctctctgagctccagactcccaattacctacttccaccctttttgacccccrgggacttatctcagcctggaattttccctctttgctctccactgaactgtccactcccagtctaagacatgtgcttatgtcacacrcccttaccgtgcttatctcagtttgtaattatctactcatttagaaaagtgttgatgaaggtcttcactgtcagctttcaggayagcaggaatcatagctgattttacttacttaacggggtttcattctttgtaactttttttttttttgagatggagactcactcttgcccaggctggagtgcaatggcatgatctcggctcactgcaacctccacctcctgggttcaagtgattctcctgcttcagcctcccgagtagctgggattacagatgcctgtcaccacgcccagctaattttttgtattttttgtaaagacggggtttcatcatgttggccaggctggtctcgatctcctgacctcaggcgatccacccayctcagcctcccaaagtgctgtgattacaggcatgagccayggcacccagccactccttttttacttatgggtgagaagccattagagattatttcttcttttctttctctcttcactaaggcaccagrgtcactaagtagtaggatactttgaactagaaytcaagaaattgagttttaattttacctcacactctcatatgaattctccatgtgacctcgggccatacttcccctgtaccctgtttcctcttttataaaagtaagagtttaaactagatggtctccgacatgcatccttctctaacatattctggraccttcaataaactaagataaagcagaataattaaaacttaatttaaaagaacacaggaaaggaagcagctacattaagcaaaagagacatcctcatggttgaagaagtgtatgccctggtgtctggatcccatttaggaaacttggtaaccttgcaatcttgggcagattgcttaatttctctagaccatgacttcctcttctgtaagatgtgataagaacatctacctcacaggtttcatgagaggattaaatgagataatgtattataatcccttgaacatggtaggctgttatgttaagtcctttcctccttctctgtagctatcatggaatttaaaaacacattataactagagcatgagttgcgactaaaggctcaattgtctctgcatgtgttggctcatgcatgctttattcctctgaagagcttttataccaagtgaaaggaaataattgcatttccctgaaaattcacaggaaaaagttatgyttttctcttcattcaagtgattctgttagacccaaccacatgcaacaattttaaagttgcttccaaatatatttacaaatatttcctgtcttcaaggaacaatggcaagaccatgactcaggttcacatccggattccaccactaaccatgtacccaattacttcagtcaccttcattcaggtcttacatatcacagaataaaatcagatttcatcagaggaggtgaagacagggagaggagatatttcaatcccttctccgcaacccccgtttttttttttttttttaacaaggatcctagagttactgaatgatagcacgtttgagggggaaagaccctaaggatgatctttataagycatcacttggtgttggtggtgataagagactcgagtatctttatgcagtggaaagagaagattggactcggaatcagaagcttgagttcaagcactggtttcatcagtcttgtgatcttgggttggtcacttaacctcttcaagggtcctcagctgtgaaagaggatagtatcagctaattcttgtaggtgcagtgaggaggcagtgagatagtgcaggtaaactataaaacaattgtcacatgaaacgcatcacagtgattctttggacmcacaagctccaatcttataaaacatatccagtcacccaccaacatagatcatctcaccttgcatatctgattttgtggatcatggggraaaactgctgattcctagcaaaacccatggcayaggataagtgcacaataatttttttttcctaaatgatttakatgacagtgactcattaagggtttcctgaggcctcctcagagtcgagaggtggrtgcctgaagccacccaaagtccctgtcacaggatggctcccaacgcacacaccacaggcctgcccagtatgttccactatctacccagtagagccctgcccagtacgttccactgtcccttccctagaagaggtgactgttgttcacagtcccagaaaagcgggctccccaaaacaatgcaaggacccacctctctctgaacctcacccaccctagttttcctttaaaaatcaatttacaagaagatcatgtgaaggaaaaggttgggtgatattctaacccaagttagctgtttctcaaccaagttctctttgaaaaattcaacaaccacytttggggaattatttacaacagaggagtgaggatgggaccaggataggtattgcctatgttggtggaaccagggtttttttcctggattaccaaagagatggtatgcattgctcccagaagctaaatatcttcaggctttcaatggtggccttcacctgaaaatgttatccctgttgaagctttcaagccagtattttcataagaactatattttctttggtgaactgaggcattataatgatgactatacaggttcttgagtgactgaagccatcattagcattgtcattatttttgtttagttgcatctccatagcagctcacattcacaatgtgctttgcaattgttccttagcaatagccctcacaagattctcaggaggagagggttaatcaggattaacatttctgtgttgcctaaagaggaaycaaggtaagcagaaatgtagccagttggctggcatcactgttgcttcaggattcatccttagacacccaagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgytttcctcccagatccatgcttttttgcgtttattattttttagagatgggrgcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacaycattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagyctctcctttcttttcttgtccctccctggtttggtatgtgacctaraattacagtcagatttcagaaaatgattctctcattttgctgataaggactgattcgttwtactgagggacrgcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctratggtggctggtgttctctgttgcagaagtcaagatggccaaagttccagacatgtttgaagacctgaagaactgttacaggtaaggaataagatttatctcttgtgatttaatgagggtttcaaggctcaccagaatccagctaggcataacagtggccagcatgggggcaggccggcagaggttgtagagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggycattaaagtacattggccagagaccacactgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttmaatacttttgttttaccctcactagagrtccagagacctgtctttcattataagtgagacyagctgcctctctaaactaatagttgatgtgcattggcttctcccagaacagagcagaacyatcccaaayccctgagaactggagtctcctggggcaggcttcatcaggatgttagttatgccatcctgagaaaggccccgcaggccgcttcaccaggtgtctgtctcctaaygtgatgtgttgtggttgtcttctctgacaccagcatcagaggttagagaaagtctccaaacatgaagctgagagagaggaagcaagccagytgaaagtragaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctragagggaactaattggaaagctaccactcactacaatcattgttaacctatttagttacaacatctcatttttgagcatgcaaataaatgaaaaagtcttcctaaaaaaatcatctttttatcctggaaggaggaaggaaggtgagacaaaagggagagagggagggaagcctaatgaaacaccagttacctaagaccagaatggagatcctcctcactacctctgttgaatacagcacctactgaaagaactttcattccctgaccatgaacagcctctcagcttctgttttccttcctcacagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacrgttgagtttaagccaatccatyactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggarataatcagaatcccccactcattggaytgytgtaaagattaagagtctcaggctttacagactgagctagctgggccctcctgactgttataaagattaaatgagtcaacatcccctaacttctggactagaataatgtctgrtacaaagtaagcacccaataaatgttagctattactatcattattattattattttattttwtttttttgagatggagtctggctctgtcacccaggctggagtgcagtggcrcaatctcggctcactgcaagctctgcctcctgggttcatgccattctcctgcctcagcctccygagtagctgggaatacaggcacccgccactgttcccggctaattttttgtatttttagtagagacggagtttcaccgtggtctccatctcctcgtgatccacccaccttggcctcccaaagtgccgggattacaggcgtgagccaccgcgcccggcctdttattattattattactactactactacctatatgaatactaccagcaatactaatttattaatgactggattatgtctaaacctcacaagaatcctaccttctcattttacataaaaggaaactaagctcaytgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacaaaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttcttacttagcaatgtattgaggacattttagagtgcccgtttttcaccattataagcaatgcaacaatgaacatctgtataaataaatattcatttctctcaccctttatttccttagaatatattcctagaagtagaatttcccagagccatgaggatttgtgacgctattgatatgtgccactttgcactctctgtgacatatataattatttttaatgcattctttttttctcagagtgcattyrtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggmatattcctaataycccctccagaactattttccctgtttgtactagactgtgtatatcatctgtgtttgtacatagacattaatctgcacttgtgatcatggttttagaaatcatcaagcctaggkcakcaccttttagcttcctgagcaatgtgaaatacractttatgaggatcatcaaatacgaattcatcctgaatracgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaagcacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcrattttaaaactgaggaaactgtcagacatattaaatgatttactcagatttacccagaagccaatgaagaacaatcactctcctttaaaaagtctgttgatcaaactcacaagtaacaccaaacyaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttaytaaacattattctgtaagtaaaaactgaactacttttcagtatcactagcaacatatgagtgtatcagcttcctaaacccctccatgttaggtcattatgaacttatgatctaacaaattacaggrtcttatcccactaatgaaattataagagattcaacacttattcagccccgaaggattcattcaacgtagaaaattytaagaacattaaccaagtatttacctgcytagtgagtgtggaagacattgtgaaggacacaaagatgtatagaattccattcctgacttccaggtatttacaccataggtggggacctaactacacacacacacacacacacacacacacacacacacacmccatgcacacacaatctacatcaacacttgattttatacaaatacaatgaatttactttctttttggttcttctcttcaccagtgaaatttgacatgggtgcttataagtcatcaaagsatgatgctaaaattaccgtgattctaagaatctcaaaaactcaattgtatgtgactgcccaagatgaagaccaaccagtgctgctgaaggtcagttgtcctttgtctccaacttaccttcatttacatctcatatgtttgtaaataagcccaataggcagacacctctaacaaggtgacactgtcctctttccttcctaccacagcccccacctrcccaccccactcccattgattccasaggcgtgcctaggcaggmtctatgagaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttstatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggcgggtcrtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggtaggacattcagaggagggggcgggtcrtggttgtgggtttttgggacattcagaggagtctgaatgcacccaggcctacaacttcaagatggtaaaggacagctccaaggatcagaagaagcattcttggaactggggcattttgagaaggaggaaaaatatgcagagactagtgcttgcagagcttgcatttggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaartggaaagaaacagacagaattgggttatattttggagatagaaccaacagaaggaagaggagaaacaacatttastgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgygtgtgygtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtgctgtttctcatgaaggccaaatkctaagggattgagcttcagtcctttttctamcatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcrtaggtctggagtctcacttgtctcacttgtgcagtgttgacagttcatatrtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctrcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctygaagccgagcctcaagatgaaggcaaagcacgaaatgttattttttaattattatttatatatgtatttataaatatatttaagataattataatatactatatttatgggaaccccttcatcctctragtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgttthaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaarcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcayattacacatacacaaaacatgtgttcccatctttatacaaactcacacatacagagctacattaaaaacaactaataggccaggcacggtggctcagacctgtaatcccagcactttgggaggccaaggtgggaagatcacttgaggtcaggagttcaagaccagcctaggcaacatagtgagatctcatctctacaraaaaaaatgaaaaattaaaaaatgagctggacatggtagtacacacctgtagtcccagctactcgggargcttgaggtgggaggatcacttgagcctgggagatggaggctgcagtgagccataatcacaccattgcaccccaacctgggcaacagagtgagacccagtctcaaaagataaatttttaaaaatgttaaaaaatatataaaagagaattttaaaagaacaactaatagatcaaagcatggatgcaagatatatttagttggaaaatcaaggttaaaatcaagggatcttggaattaggtgtggtagatttgggtaaggagtagtctaagatgaccctgtttcttggtactggagactggatgagtggcagcrtcttaaccatatttttggtagaaatatggaggtcttctccattccaggatgaatgatgagtaaaattttaggcatgtaatttgagctactagaaggacactcaattgcagatgtacaatggggagatgataacctatctggaactcagaaaaataactgtatatagatatgaaagacatcagtaggtatgtagtagataaaatcctaaaagtgatgtcaaagggagaagagaagtatatggtgaacactgttgtttgtccatgcaattgccatctcttcttcttccttactgacagaaccctgatttcactgagaagtcaacatgcccttccccaattgatgaatccaattggtttaagattatgttcattctattcttacatgactaagtcacgttgacttaatcctatcaaatgagatgtcgatctggaaacaacttctggaaaagattttctaccttgataaaataaagagccatatagatggtcctttatcttccttcttccttgaatgagatatgttctatgaggaagtgaagcttagaactgtggtcagcaacttgcaacgactgggaagtcagagccacacaatgaagaatgcagagtggaaggaraaaaagagccagcatctctgacaacattgttacaccgagaacctacctccagattttaagaaaacaagaaatgctactgttattaagccatttcactgggtttgctatgacttgcagtcaaatctagcttaactgatacagagcaccacagagaactggtctctcatttgtctcatcctgttctttctagcagccacgactttcctagggtttccttagcccaagtctggctagagcaagactaagtaagacttgattcctyaatgtccttttgttttaagaaatattaaagaattatttttatrttaatatattttaagaaataaggaaatacaaaacactgagcaagcaacacaaattcaagaaatcttaaaaagtataatagctgctcagtctctgattaacagtgaaatatggaatcattgtagaaatggccttggagcgttattctcccaggccagctatccttatggtctgccccacctccctcattgcctaaacagtaagagagtcaccatggtgagactcaacagtcttagcacagaacttgttacagtctatttcttttcttacagtcctatatatcaagttccaaatcaatgagagtaaagccaaatccctgcctttaaacccaagggacagaagcaaaaagccaaaagatatttccctaaccttcctcccactgagtagactcctctgacatttaaaaacccctacgcttgaaatttgaggggtgatggaattgttgagatggtaataattattgtggtggatataaaatatgctcgtgtatctatatctctgaatgactgaatgatttataagtttaatggttatatacatttctgacttttaaaartgaatgtatgagtatatgacaatataataatttacaaaaaaaatttattatctatarcacctcattgaactatacataaaatagattaaattatacctcagtaacaaaggattttttttaatttacaaggaaaaaactctttattccatttatcgcgttgtgtatccagagtggtcttttttttttttttttttgtaccctctctcaaccctaggcatgagatgttcatttatcctaaaatgctctatagggtaatttacctttcttgtggatacattgtttgcatttccctgtcattggctctcactggccaagaacacctttgctccttcttctctaaaacttattcctcaccaatttttcttttyatcagagtggctgacaaagggtgttatgcaaccttatgagctctgcagggtaaactgaggtctggctcaaaagtatacatccctgggcctcacctctggagattcagtcagtttgggtagaccttgagcatcttaatttttttaagctccaaaagtaactctcatgtttatcactggttaagaaccactgcatgaagagagtcccagattaaggatggttttattatagtgttaataatggcttccytttgggcaagtcaatccagggttagaaaagatgagaacacacaacttccacctatccagtagaggccttctcacagccacagggacacyggcaggcctcatttggaaataaggtactcaacagcacaagtacccccattttatatactcacttatacttgcgtagaagctgaggggcctgccaagcaggtgcttgcctttggtgtcactcttccaaaaggtctggagtgctttgcccaattgagagaggcctatggaataagaaaaacatgagtggatggtccctgtcttatcttctcaactstccacactctaaaaaacgactttggctcctagcatgacaagagccttgattttcagaggaacactcccttctcatctccaccaagaagtagagctaatttccttccacacagctcctattcactatttcgtagatggtgaagtcatttctttgtcatgtaaggagaaatgctgttactattttttaaaacagaaaggagagggtttatggagattacagacaggtattcttgatacgaatgtattgcatcaatttagaagatttttcaacagatgttttgtgcatatgtagaataaaatgctgcaatctcaaggtctcaggctgggatcactaagaacaagtcatgctgcagacctcattaccacttttgatgggattacctgagtggcattggcaggtatatctctattgtggcrgtgagtggactgtggcttaatgtcattaagcatttggatcagatagataattcatcttgttctgatccataccaaaggagttttcttgaagttgttttgtgtttgtttttgtttgtagagacagggtctcactatgttgcccaggctgttctcaaactcctgtcatcaagcgaccctcccaccttgacctcccaaagtgctggaattacaagtgtaagcccctgcacctggccttcaccaaaggacgttcttattatagatttcctgcatatttgcctacaggaagatgatgcactggctagaggtgtgaatgtcaggtctcttctgccattctaaccctgttataaagtaaaattggctctccatcttataatttagtctccttgaatttagaatactgtagagtttggaatcaagaccggattcaaatctcatttactttgtgatttgtgctagtcttttaatctctcaatgtcagtttccttacttgtaaaaatggagatagtcattactattaacacatcaaatatttgtaatatcaaatgagataaaatacagaaagagcttagcatagcaccatggatttagagtgtttgattcattcattattttacttaaaagtagctattatcacttttacttagtgaatgcatccctgagaatctaatccacaatcacgataccaattaaatcaagttcctgaatccacactgagggttggctcaagcaattctcccacctgggtgaaggtaaatattctacaaaccatcaggtaaagttacttgaccagccagtcagccatctttggtgacttcaacccagccatacttatttcttttctgggagggttgggggtgtggttcatagagatggggtctctctatgtttcccaggctggtctcaaatgcctggcttcaagcaatcctgccaccttggcttcccaaagtgctgggattacaagcatgaaccaccgtacccagcctgtattttgatttttaccattgcatttagcaaagtctctactgatattgtggtagacaaggcagagacatatgggctataagagctagtagtattattgaatgggcttgtggctacttatayatagtgtggttactgtattgaagggatctttaaaaggagaaagccctattcattcaaaagacattaatttagtttctatttggtgccaagaacaatgaatatagtggcctaccctcagtttacagactagcagggagaaagataagcaaataatcaagctaatcacaatccttgagaaagggatgttttgtctgagactgaaggatggttaagagtcaacaaagagactagcctggccaacatggtgaaaccccgtctctactcaaaatacaaagaaaaaaattagctgggaatggtggcaggtgcgtgtaatcccagctacttgggaggctgaggcaccagaatcacttgaacacaggaggtggaagttgcagtgagctgagatcacaccactgtattccagctgggaaacagagtgaggctccatctcaaaaaaaaaggaagaagacaactgacccaatttaaaaattggcaaagactctgaatagagatatacaaatggccagtaaacacataaaaagatgcttaacatcattagtcatcaaggaaatacaaataaaaaccacaatgtgataccatttcacaaccactaggatggttgtaatttaaaagatggacaataacaagtgttgttgaggatgtaaagaaactggaactttcatacactgctggtaggaatgtaaaatgctgcagctgctttggaaaacagtctggcagttcctcaaatggttaaagatagaattatcgtatgacacagtaattcctctcattaggtatatacccatgagtgttgaaaacatatgtctacacaaaaacttatacatgaaagttcataacagcattattcataatagccaaaaartggaaagaacctagatgtccawyaactgatgaatggcaaataaaatattgtatatccgcacaatagaawacccagtcataaaagaatgaagtactgacacatgctatgtggataaaccttgaaaacagcatactaagtgaaagtgaaacttaaccaatagtcccatagactgttctttcggataaacatagaaattgacgcttctggtcttaaagctggaagcttgtatttgttttgtttgagttccttcctggggaaaakacttcaggcctctcaaaaaaagtatcaaagaactgaaactcgccagatcaccacatccaggcaatgagactttggaccactcattcatcaggattgcttccttgcccctccctggttcctgttttcttacgcattgttacatttcttccctgctatccaaacccctggttttaggtcagggagat

SEQ ID NO: 13202 - DNA, 19071 bp, Homo sapiens
tagacaggaaaggttgatgcgtgggataggagaggagggcaggggattccaggtgggccctgcttgccacactcaggagcttgaacttatccacaaaggagrtgtggaaccagtaatgaatgggttttgtgcaagggcttcatgtcaccagatttgctttttggagatacttctgtggctgatatgtgaggaagggatggaggaagtttccgtggcaatcaggaaaaccaattagcagatgattcaaatggcctaggggaaaagggaggaggacttggactaccatgcagcagcagaaatggagagaaataacagatcccaggcactcaggaagcgctcagaatgagcccttcaaagaacttatggtasgtgatggatggatggagtgtgagtcctgggatagcattgcctgggaaaatactttctagttgagacagggaagtgggccagcagaaatggagggcttcttctttttgctttaaatacttttataatatttggaactttgaaaatgagcagatatattagcaaaaagcctaaaagggatatttttgaaatcactgctagttctaacatataactttcagcttgcacacatcatcaattaactttgatagcgcctttctgaaactatcatcccaaatagcaatccttgtaaaaacctattttgaaaaacgggccttgtaggatagcctcacagatgttttgtggtagattttctaacattctaatgtcagggagtgaaaggaatcccgttagaagttggaaaattctggaatctctattcatggtattaaagttttgccgtcacacaaaagtttaacacctttacacaatcagacttcctcattttacattgctcggtaattagaggaaatcagtcacccagagcctgggtcctagacttgacaaaatgcacccaacaaatcctgagtggccttgctgaggacttctcccagaagatagaaaactcagttccagccaacaagggggaagcagctgaagaagtgaaattaacaaagtcctggaaggaaatgaccaaatcatctttgattgtgtaataaccagagagtagaatacagcaacgacagacattttgggagagaagcattttatcatagcttttagaagagaagtatttttcagcatcataagcacacaattccaaggacagataccttcaagggattgcttttgacagttatgacaaagtcttaaagaagaataaaaggacaaaggaaatcctccagcaacaaagctgccacttatagatgagaaagtgaatgggaataaggaagaaactcagaaaagggaagagagatcactaaaaaccctgatttggaaagtcccagtactaccctgagaggagaaagaaacaaattcacacagcacgtcaccgccagaagaagaaaggagggaagacaagggaacagagaggatctcaatcctaaaaggacaatgtggaaacatttaggggacagaggtgaatctgccaggccaatgtagtttagaatgtcactcaatcactgagaatgagaaaggagtctgccgatgggcaccatgtggacaggagatgaggcaataaacatatgtaacaattaaaagtgagaaataaagatctggttttggttcagttaacccatatttgagtcgtagttccagcatttactgtttgtgcggtcttaaataatttattgtctcaacctcagtttctgrataggtcaaatggttcaatattatctactttaaaggttattatgaagagttaataagataatgagggaaaaaaaggtacctggcacttagtaggtgctcaataaaggacggctttttttttttaagtattgcttctaaatttgtatgyaagaaaaaatgatataatacaatgatataagacaggggaccgcaggacaagtccagccacacccattcatttatgtattatctgactgcttttctgaaatgatgcaaggttgagtagttgtacctgaaacatttattatctggccctttacagaaaatgtttccagaccctggataagtggtaccagagccccctctgtttgtggtcccctctcttatacccactaggtgtgagaaaagacatagagtaggagagcsctgccatccatcttacccacccaggggctttttctgatggatccaaaggaargacaaggtcttattggtctcccagaactgacataacaactccgacatcagggaaaagccattggagactacatagctcgccagccccagccacctgctcatatatctaagccctccttgttctagaccagggaggagaatggaatrtycctyggactctgcatgtccccaatctgagaacctggatccaagagggagaagaagcccattggagatgatgccataaaggaagtggaagcgatatgataaaaatcatagtgcccattcccaaataatcccagaagcagaagggaaaggagagaaatatccacaaagacaggtgtgggtacacacaacatttttcatactttaagatcccagagggactcatggaaatgatacaagaaaatgactcataagaacaaatattaggaagccagtgccaagaatgagatgggaaattggggaaaatgttgggggcagattgcttagttctgttctaagcaagagggtgaacaaggaaggaacagctcactacaaagaacagacatcactgcatgtacacacaataatataagaactaacccatgattattttgcttgtcttcttgttcaaaatgattgaagaccaatgagatgagatcaaccttgataactggctgcgaagcccatgattagacacaagatggtatcagggcacttgctgctttgaataaatgtcagtctcctgtcttggaagaatgacctgacagggtaaagaggaacttgcagctgagaaaggctttagtgactcaagagctgaataattccccaaaagctggagcatcctggcatttccagctccccatctctgcttgttccacttccttggggctacatcaccatctacatcatcatcactcttccactccctcccttagtgccaactaygtttatagcgagatattttctgctcattggggatcggaaggaagtgctgtggcctgagcggtctccttgggaagacaggatctgatacatacgttgcacaacctatttgacatragaggtttcacttcctgagatggatgggatggtagcagatttgggtccaggttacagggccaggatgagacatggcagaactgtggagactgttacgtcagggggcattgccccatggctccaaaatttccctcgagcgaaagcatcaggggctcatgcaacctggatactagtgctgcttcaaccacactgtgctattggatgagtcacttccaccctcctagccttgatttcttcgtctgctgttcacattcaaatagctattcatgtcttcatctctgtggtcccaccatatcccaccagacaatcattagggctcctcttagctggcagattctgaggtcctggatgctacaattggaagatggagaagtagaagctcaaggtttctgacctgtatcccaagtcccagaagcagaatggactaactcagagctgatgctcgggtcccttgcatatctcccttcctgtcactggctttgatcctccttcgttcagcttgtaatcacatcaacagaccaaagacatctctgtgttctgtcaggagagttcacagagccaccaaccctccagaccctgctggttgccgcataaagactctgaggaagggtttgaggctgctgtgatcatgcaatgaatgcatgattgtaccactgcactccagcctgggggataaaggtagatcctgtctaggagagagagagagagaaagagaaagagagagagaagggagggagagacaaagaaaaagagagagagggagggagaaagaaagagagaaagaaaagagaaaagaaagaaaaagaaagaaagagagagagggagggagggagagagaaagaaagaaagaaagagaaagagagaaagagagaaagagaaagaaaggaagaaagaaagaaagaaagaaagaaagaaaagaaaagaaagaaagagagagagaaagaaaaagaaagaggaaggaaggaaggaaggaagaaagacaggctctgaggaaggtggcagttcctacaacgggagaaccagtggttaatttgcaaagtggatcctgtggaggcaaaacagaggagtcccctaggccacccagacagggcttttagctatctgcaggaccagacaccaaatttcaggagggctcagtgttaggaatggattatggcttatcaaattcacaggaaactaacatgttgaacagcttttagatttcctgtggaaaatataacttactaaagatggagttcttgtgactgactsctgatatcaagatactgggagccaaattaaaaatcagaaggctgcttggagagcaagtccatgaaatgctctttttcccacagtagaacctatttccctcgtgtctcaaatacttgcacagaggctcactcccttgsataatgcagagcgagcacgatacctggcacatactaatttgaataaaaatgctgtcaaattcccattcacccattcaagcagcaaactctaccacctgaatgtayatgccaggcactgtgctagacttggctcaaaaagatttcagtttcctggaggaaccaggaggagcaaggtttcaactcagtgctataagaagtgttacaggctggacacggtggctcacgcctgtaatcccaacactttgggaggccgaggcgggcagatcacaaggtcaggagatcgagaccatcctggctaacatggtgaaaccctgtctctactaaaaatacaaaaaattagccgggcgtggcggcaggtgcctgtagtcccagctgctggggaggctgaggcaggagaatggtgtgaacccgggaggcggaacttgcagggggccgagatcgtgccactgcactccagcctgggcgacagrgtgagactctgtctcaaaaaaaaaaaaaaagtgttatgatgcagacctgtcaaagaggcaaaggagggtgttcctacactccaggcactgttcataacctggactctcattcattctacaaatggagggctcccctgggcagwwccctggagcaggcactttgctggtgtctcggttaaagagaaactgataactcttggtattaccaagagatagagtctcagatggatattcttacagaaacaatattccacttttcagagttcaccaaaaaatcattttaggcmgagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagytccygaggcagagaacagcacccaaggtagagacccacaccctcaatacagacagggagggctaktggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagakaaatttctcagcctcctacttctgcttttgaaagcyataaaaacagcgagggagaaactggcagataccaaacctcttcgaggcamaaggcacaacaggctgctckgggattctyttcagccaatcttcattgctcaagtatgaytttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagaygctgagaccagtaacatgagcaggtctcstctttcaagagtagagtgttayctgtgcttggagaccagatttttcccctaaattgcctctttcagtggcaaacagggtgccaagtaaatctgatttaaagactactttcccattacaagtccctccrgccttgggacctggaggctatccagatgtgttgttgcaagggcttyctgcagaggcaaatggggagaaaagaytccaagcccacaatacaaggaatccctttgcaaagtgtggcttggagggagagggagagctcagattttagctgactctgctgggctagaggttaggcctcaagatccaacagggagcaccmvrggtgcccacctgccaggcctagaatctgccttctggactgttctgcgcatatcactgtgaaacttgccaggtgtttcaggcagctttgagaggcaggctgtttgcagtttcttatgaacagtcaagtcttgtacacagggaaggaaaaataaacctgtttagaagacataattgagacatgtccctgtttttattacagtggcaatgaggatgacttgttctttgaagctgatggccctaaacagatgaaggtaagactatgggtttaactcccaacccaaggaagggctctaacacagggaaagctcaaagaagggagttctgggccactttgatgccatggtattttgttttagaaagactttaacctcttccagtgagacacaggctgcaccacttgctgacctggccacttggtcatcatatcaccacaktcactcactawcrttggtggtggtggccacacttggtggtgacaggggaggagtagtgataatgtttcccatttcatagtaggaagacaaccaagtcttcaacataaatttgattatcctttyaagagatggattcagcctatgccaatcacttgagttaaactctgaaaccaagagatgatcttgagaactaacatatgtctaccccttttgagtagaatagttttttgctacctggggtgaagcttataacaacaagacatagatgatataaacaaaaagatsaattgagacttgaaagaaaaccattcacttgctgtttgaccttgacaagtcattttacccgctttggacctcatctgaaaaataaagggctgagctggatgatctctgagattccagcatcctgcaacctccagttctgaaatattttcagttgtagctaagggcatttgggcagcaaatggtcatttttcagactcatccttacmaagagccatgttatattcctgctgtcccttctgttttatatgatgctcagtagccttcctagkkkgcccagccatcagcctagctaggtcagttgtgcaggttggrargcagccacttttctctggctttattttattccagtttgtgatagcctcccctagcctcataatccagtcctcaatcttgttaaaaacatatttctttagaagttttaagactggcataacttsttggctgcagctgtgggaggagcccattggcttgtctgcctggcctttgcccccattgcctcttccagcagcttggckctgctccaggcaggaaattctctcctgctcaacwttcttttgtgcacttacaggtctctttaactgtctttcaagcctttgaaccattatcatgccttaaggcaacctcagtgaagccttaatacggagcttctctgaataagaggwaagtggtaacatttcacaaaaagtactctcacaggatttgcagaatgcctatgagacagtgttatgaaaaaggaaaaaaaagaacagtgtagaaaaattgaatacttgctgagtgagcataggtgaatggaaaatgttatggtcatctgcatgaaaaagcaaatcatagtgtgacagcattagggatacaaaaagatatagagaaggtatacatgtatggtgtaggtggggcatgtacaaaaaagatgaacaaagtagaawygggatttattctaaaagaatagcctgtaaggtgtcagaaagcccacattctagtcttgagtctgyytctaacctgctgtgtgcccttgagtacacmcttaacctccttgagcttcagagagggataatctttttattttattttattttattttrttttgttttgttttgttttgttttatgagacagagtctcactctgttgcccaggctggagtgcagtggtacaatcttggcttactgcatcctccacctcctgagttcaagcgattctccttcctcagtctcctgaatagctaggattacaggtgcaccccaccacacccagctaatttttgtatttttagtagagaaggggtttcgccatgttggccaggctggttttgaagtcctgacctaaatgattcatcmacctcggcttcccaaagtgctgggattacaggcatgagccaccacgcctggcccagagagggatgayctttagaagctcgggattctttcaagccctttcctcctctctgagctttctactctctgatgtcaaagcatggttcctggcaggaccacctcaccaggctccctccctcgctytctccgcagtgctccttccaggacctggacctctgccctctggatggcggcatccagctacgaatctccgaccaccactayagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccactcccagcttcatccctactggtgttgtcatcagactttgaccgtatatgctcaggtgtcctccaagaaatcaaattttgccrcctcgcctcacgaggcctgcccttctgattttatacctaaacaacatgtgctccacatttcagaacctatcttcttygacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaayttaaggcaaatgatcaacacaagtgaaaaaaaatattaaaaaggaatatacaaactttggtcctagaaatggcacatttgattgcactggccagtgcatttgttaacaggagtgtgaccctgagaaattagacggctcaagcactcccaggaccatgtccacccaagtctcttgggcatagtgcartgtcaattcttccacaatatggggtcatttgatggacatggcctaactgcctgtgggttctctcttcctgttgttgaggctgaaacaagagtgctggagcgataatgtgtccatccccctccccagtcttccccccttgccccaacatccgtcccacccaatgccaggtggttccttgtagggaaattttaccgcccagcaggaacttatatctctcygctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatyctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcytcacctctttcctttccttccacattgatcaagttgttccrctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaaattacatgtatcctactcwtggggcctaggggttggggtgaccctgcactgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaaccaccttctcccyrcccccatccctaggaaaagctgggaacaggtctatttgacaattttgcattaatgtaaataaatttaacataatttttaactgcgtgcaaccttcaatcctgctgcagaaaattaaatcattttgcygatgttattatgtcctaccatagttacaaccccaacagattatatattgttagggctgctctcatttgatagacaccttgggaaatagatgacttaaagggtcccattatcaygtccactccactcccaaaatyaccaccactatcacctccrgctttctcagcaaaagcttcatttccaagttgatgtcattctaggaccataaggaaaaatacaataaaaagcccctggaaactaggtacttcaagaagctctagcttaattttcacccccsmmaaaaaaaaaaattctcacctacattatgctcctcagcatttggcactaagttttagaaaagaagaagggctcttttaataatcacacrgaaagttgggggcccagttacaactcaggagtctggctcctgatcatgtgacctgctcgtcagtttcctttctggccaacccaaagaacatctttcccatrgcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggamtttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcaktgtctgtaaaagagcctagtttttaatagctatggaatcaattcaatttggactggtgtgctctctttaaatcaagtcctttaattaasactgaaaatatataagctcagattatttaaatgggaatatttataaatgagcaaatatcatactgttcaatggttctgaaataaacttcactgaagaaaaaaaaagggtctytcctgatcattgacttgtcttggatttgacactgaacagtaaagacaaacagggctgtgagagttcttgggggactaaagcccactcctcattgctgagtgcygcaaagtacctagaaatatccttggccaccgaagactatcctcctcacccatcccctttatttctgttgttcaacagaaggatattcagtgcacayytggaacaggatcagctgaagcactgcagggagtcaggactggtagtaacagctaccagtgatttatctatcaatgcaccaaacatctgttgagcaagcgctatgtackaggagctgggagtacagagatgagaacagtcacaagtccctcctcagataggagaggcagctagttataagcagaaacaaggtaacatgacaagtagagtaagataaagaacaagaggagtagccaggaaggagggaggagaacgacataagaatcaagcctaaagggataaacagaagatttccacacatgggctgggcatggtggcttacgcctgtaatcccagcactttgggtggcaggggcagaaagatcgcttgagcccaggagttcaagaccagcctgggcaacatagtgagactcccatctctacaaaaaataaataaataaataaaacaatcagccaggcatgctggcatgcacctgtagtcctagctacttgggaagctgacactggaggattgcttgagcccagaagttcaasactgcagtgagctgtgatcgcaccattgcactccagcctgggtgacagagtgagaccctgtctctaaaaaatgttcccagatagaaaagaaaagaaaaagccctcaggtagaggaaccagygtgaacaagagcatgggtgtataagaatgaatgatgcaaaaagtacactttcagaattgcgggaatcaccagaagcaaagtcaaagcgcaaaacaagccagaggaaaagtagttgtaactcacaccccagataaagagataacttgtttcacatgtaaagaactgcctcaaaacatttgaaaaaaaagaacaaaaatccagcaaaacaagaggcaagggatcttaacagtctgttcacagaaaagaaaatactatttgatcttgggcagagtaaaatgatgcttaacattgtaataagaaagtcaaattaaaagcactttgagatactagtattttcccatcagattgacaaaaatcaaaagtttaacaacagaccttgttggtcaaactgtcgggaaatccccactgttaaatattacgcgtgggactataaattgatatgacccttatagaacaaaatttgctaactatgaaaatcacaagtgcacttcccctttgatccagcaatttcactcctggagatttatcccacagatggacataacccatgtgaaatggaaaatgatcaaaattattcattgcacatcatttgtaataggaaaaattggaagtaacccaagtgtctatcaacaagagactgcctaaatgaagtaaaggacatagaatactaggcagctatagaaaagaatgagaaagcactctggtattgtttggttctgtgtcccagcccaaatctcatgtcaaattgtaatccccgatgttggaggtggggcctggtgtggggtgattggatcatgggggtggagttcttatgaatggtttagcactatccctttggtgctgttctcgtgacagagttcccacaagatctggttgtttaaaagtatgtggcatcctttctctctctctctctctctctcagtcctgctcctgccatataagacatccactcccgctttgtcttctgcatgagtaaaagcttcctaaggcctccccagaagcagatgctgccatgcttcctgtggaacagcctgcgaagctgtgagccaattaaacctcttttctttataaattatgcagtctcaggtatttccttatagcaatgcaaggactgactaatacatgctgtctgcacgaatatgaaatcctctccaaaacatgctgatagctgaaaaagaagaaaatgcagaccgtatttatgatatgctaactctgatgtaacaaaagggaggggaagaagggcaatacattccactgtgcttgtatttgattttttttttttgattctggaagatacataagaaatgaataaagtagttgtcrgaggctgaggaataagatatatagggacaggtgtgggagcaagacacttttatgaacacattttacacagtttgggttttttttttttggagacaargtctcgctgtcacccaggctggagagcagtggtacagtcatggctcactgcagccttaaactcccaggctcaagcaatcctcttacctcagcctcctgggtagctgggaatacaaacatatggcactatattcatccactctcacactgctataaagaatgacctgagactgggtaatttatgaagaaaagaggtctaactgattcacagttctacaggctgtacaggaagcatagctgggaggcttcaggaaacttacaatcatggcggaaggcaaaggggaaacacacacrtcttactatggcggagcaggagagtgagagagtgaagggggaggtgctacacactttcaaataaccaggtcttgtgagaactcactcactatcatgagaacagcaagggagaacccacccccatgatccaatcacctcccaccaggaccctccctcaacattgaggattaaaattcaacatgaggtttgagttgggtcacagagccaaaccatatcagccaccatgcccaactaatttttgtttttaaatttttgtagatacagggtctcactatgttacccaggctggtcttgaactcctgggctgaagtgatcctcccgcctcggcctcctaaattgctaggattacaggcataagcagccatgcctggcctacagtttgatttttgaatcatgtaaatatattattcagaaataaaataataatttttaaatattttatcccaaaaaaatgtatctgacttcttgtggaaggacaactgttgagttgagggagctgccagtcttcggcagctcactctcaataccctccttctttgaagttctccaagctagggcagaggctggcaaagcccctctcctagctctgtctgcttcataactgcagtgcaaaggatgacatggctgtcggagcagacacccaagtggcaaccattctataagatggaacagagctggtggcaggaaagcaggtggtctgggaagaaagcagaggtgcctgtgagcttgagctgtcatttgaccctctatccttgatttagtgacacaattctgccagctctctcagatacaaaagggaagacatgccaggaagaatgaaactgtgaaggcatctcaccttgtgaggaagccagattccaaatcatctctgtatggktaagtgggtatggccattttggagagaaaattggtagcgtctagtttttttgggttttttaaacatgttctttggctcagcaattccactacttgccatcttccgtaaagaaatttatggacatctactgatgcgttgtttataaatacttaatgaaatcaactagaaacaacctacatatctgttgatagaggcaaggttaaataaacaatggtaagttaaaaagaaaggagatgctactgaaatagaaagatagccaagcaaatcattgagagaaaaaggcaaattatggaacaagaacagagtgataacatttacgtaaaacaaaacactgcacatcctcaatgcaaaaccatgtgcttctaatggtatatagaggtagagaggtctggaagggtattggcaagactgataatagtggttacttggagtggaatagggcagaggagcgagtcatcaagaggaactttagctttatttatgacatttgaatttttaccaaaaaaaaaaatttggtaaatgtgtttaacaaattttgttttattagatttttgttcttattttttctagtgttttgagggatctctttagatgttaagcaaatatattcgtgaatgactcgtatcatttttttaatcccctgcattaaaatgttcaaaagccttggttccaattcctggatctgagccaaagatcaaaattgaccctccagaccagaactgacctttctattacaggtttagagccaagttctctccctgggtaacaactccctatttctctgtactatgtgcccttggcctggacgagggaaatggtctaccactaaatggaaagggtctgataatttgagtggagaaagctgagaatcctccccacacccaagcaagtacacaaatacaactggaagaaggcagtctttctgaagggctgtgaagtcaacttctctgcacctgcagcaggtaacacaccacacytccacagctgctaccagctttccaggagagcctgtgtacctggagaggagaaggcaagtgcttccgaacttgacttgatgtcttagattctgcaatgcgtagtctgtagggacaggctgtrgcttatcctataggcttgggctggagtcagcaagcatctgggctggcagaagataaaagatgcaaaggtggaggaaagcatacgtggtctggaagacagacttggtgggtgggtggctgctacaacaccctagttagaggtagaggggtaagtcagtgtgtcttctgcacaggcctcttccccacctcattcttcatttcccatacagccttgctgagttattcacaaacatctgattcaactggaagctgggttgaggatgacctaaaggactagtgtgatgcctgcccaggggtgtgggcccatagtcagagtccagagcctcctctcagcttttagcacatctcacccacatcctgggtccttaattagcaatatgaaagcaagccaagtgacaagattttgtccctgggaagtccagaagcactccttttctcatttgtataagcataatgatttgcttacataaataatcatgaaaattcaaatccctctcagaaatcaggtcataaaaccatgaaatgcagcatgtgggcaagaatcacagggaaaggtaggtcttggagaggaaaggatggcagggaggaagaaagcagggtgccaggggccctgggckgctgtccaagtcaggtggctcaccgtctctgagaacatttcactttctggtaaatggggcagttggagatagaagggttgggtgaatgccaagagtgagcacagctgaggtcagtgctgtgcctgcagtccaggcgggagtagaaatcctgggcccatcttacctccgacctcatttcctcctctgtaataatgtgggggtgggggaaagttctggtcatcagccctagcattccatggttcatttcctcatcagtgatggaaaatcaccaagcaagagaacaggatggagaataaccggatgggtgcaatcggaggtgctatttcaggtgaggtggccagggaaggccctctgaaagggtggcttgagcaggtggctgaatgtacagaagctgccaatcatgaaagatctggggtacagcatgccaagcagaggaaatgcgagtgcaaaggccccgagattggatgtgggcttagcacaaatgtggcatggcaagaaggccagtgtggctgaagcagcatgaacaatgggtggaggggctgagaggacagaggagcaggaaagagccaggcttgggtaggagaggtgtcaacttgatatatgatgcaaagcccttggaggttcccaaacacaaaagcratgatctaatatatggttttaaaaatgccactcttggcygggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggc

SEQ ID NO: 13203 - DNA, 45268 bp, Homo sapiens
  misc_feature (1)...(45268): n = A,T,C or G, or insertion/deletion polymorphism (see Tables 1-2)
aggaatttatctatttcttctacattatttaattagttgatgtactgtttttcatagtagtctcatgattttctgtatttctgtggtatccattgtaatctttcctccttcatttataattttatttgagttttttttctttttctcctaattaggctaaagatttcttgatttatctttttaaaaacaataacagtgtcattgaccttttctgttgtttttctagtctctatttcatttatctctgctctgatctttattattttctttcttcctctgtctttgggcttagttttttttttttactttcttattgcttcaggtgtaaagttaggatatttcagatctttccattttcttaaggtaggtatttatcgctataaacttccttcttagaactgcttttgctgcatcccataaattttcaatgccacaaattttgtttctcttttcatttttctcaagacattttttgattttccttttgatttcttctttgactcattggttgttcaggagtatgttaattttcatgtatttgtgaattttccatttttccttctgttactgagttctacttttatgccattatggttggaaaagatacttgatatgatttcaatccttaaatttgttaagatgttttccatggcctaacatataacctatcctggagagtgttctgtgtgcacttaaaaagaatgtgcattctgctgcttttgaaaggaatgttctgcacatgtccgttaggtctattggtttatagcattttgaaatccacagtttccttgttgattttctgtccaggtgatctattcattgttgaaagcatgttgctatttatttctcctttagttatgttaatatttgctttatagatttagatgcactgattttgggtacatgtgtatttacaattgttatatcctcttaatgaattcacccttttaccattatataatgaccttctctgtctcttgtgacagtatttgacttaaactctatctcatctgttataaggatagccacctctgctttcgtttggttatcatgtgaatgcaatctctttttcatcccttcacttccagcttatgtctgtccttaaagctaaagttagtctcttacaggcagcatatagttagatcttgttttttattcactcatccactctctcttttgattggataatttaatacatttacatctaaagtaattattggtaggtaaaggcttactactatcatgttgttaattgttttctgattgttttgtagttcctttgttgcttctttttgtctcactgtcttcctttgtgacttaataacttttttggagcaatttgctttggttcctttctctttatgttttgtatatctactacagactttttctttgtggttatcatgaggtttacataaaatatttcatagttataacyatccattttaatctggtaacaactttgactgcatttaaaaatactgtattttaacttctcctcctcccacattttattattcatgccatagtttatatcttttgtatgttgtgtattcattagcaaattgttgtagttatagttatttgttaatactttkgttttttaacttttatactagagttaaaagtgactgttgcacaataacagtattggagtattctgtatttgactgtataagaatacctttaatagagttttattctttcatttgttttcatgttagttagtgtccttttgtttaaacttgagaattccctttagcattttttgtaaggcaggtttaatggtgttgaaatcccacagcttttatttgtctggtgatatgatttgttcctgaacttccacccaaatctcatctcgaattgcaatccccaggtgtcaaaggagggacctgttgggagatgattggatcacgaggtgttttcccccattatgttctcatgatagtgagggtgttctcatgagatctgatggtttaaaagtggtggttacccstgcgcacatgctctctctctctcctgctgccttgtgaagaaggtacctgcttccccttcaccttccaccataattgtaagtttcctgaggcctccccagccatgaggaactgtgagtcatttagacctcttttgtttataaattacccagtctcaggtgatatcttttagcagtgtgaaaataaacaatacagagaattggtactggcagagtgaggtactgctataaagacaacctgaaaatgtgaaggcaactttgaaactgggtaacaggcagaggttggaacagtttggagggcttagaagataggaagatgtgggaaagtttgaaacttcctagagacttgttgaatggttttgaccaaaatgctgatagtcgtattgacaatgaagtccaggctgagatggtctcagatggagacgagaaactattgggaactggagcaaaggccattcttgctatgctttagcagagactggcagcattttgcccctgccctagagatctgtggagctttgaacttgagagagatgatttagggtatctgtcagaataaatttctaagcagaaaagcattcaaatataacctggctttttctgaaagcatacagtcaagtcatatgcgttcacaaagagatggtatgaaattggaacttatgtttaaaagggaagcaaagcataaaagtttggaaattttgcagcctgaccawgtggtagaaaagaaaaaccaattttctgaggaggaattcaagccggctgcagaaatttacataagtaatcaggagctgaatgttaattgccaaacaatggggaaatgtctccagggcatttcagaggtcttcaaggcagcccctcccattacaagcccagaggcctaggagggaaaaatggtttcatgggccctgctgctctgtgcagccttgggacttggtgccctgtgccccagccactccagctccagctgtgactaaaagggtccatagctcaggctgtcgcttcaagggtgcaagccccaagccttsgtggcttccacgtgctcttgggtctgcgagttcacagaaaacaagagctgagctttgagagcctctgcctagatttcacaggatgtgtggaaacacctggctgtccaggcagaagcctgctgcagggacccagccctcatggagaacctctattagggcagtgcagaggtgaactgtggggttggagcccacacacagagwccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgkgtgtgagacaggggctccaaggagattattttggagctttaaaatttaatgacttccctgctaggttttgcatatgcttgggacctgtggcccctttattttggccaatttytcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaacygtgagtcagttaaacctcttttgtttataaattacccagtctcaggtagtatctttacagcagtgtgaaactggactaatacatctgggaaattctttttstctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttctttttttttttttttttttagatggagtctagctctgttgtccaggctggagtgcagtggcgcaatctcggctcactgcaagctccgtctcctgggttcacrccattttcctgtctcagcctctggagtagctgagactacaggtgcccaccaccacgcctggctaaattttttttgtatttttagtagagatggggtttcactgtgttagccaggatggtctygatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctctttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggtyttgtgtggccatcttggagcctgaagccccaggggctgacctggtctggggtgagcatgggkctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggyataacctctcacctgattccttagctctagtgaagttattttcgtgcatggatacttgttcgaattgatgtttctgcaagggatgagygctagaaactcctgttctgacaaactcctattcctattcttgctgacatcactccctgaaatagttaatayacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatcatttatattctaatttcctgagtatgtagagagtatagataatgttcctttatgtagaaatatttaaatgtaagatgattytaaatcagaaagaatatttgattgatttaaaatttttaaatgggctttaatattttcagaggttttctttacttagggatttttggactgacattattgccattatttattaattttgtttttgcccaaatcaagaggtttcataattgtttactctctctctaccaattccctttccaacattactagccacagagttggccaatgaacaataaacacaacagtagtctggaggtctcaatttgtatcttgggaagcattataaattttccaactccctagacacaaatgtaccaaaaaaaamcccttgttttctataccagtaatygtgtgctttgtcttgcaattcagacatttacaagaaaatctaaatcaccttaaattaagatttatgttaaatgtggtctaaaaccagcagagttatgtattgttttcttttttagaatgattttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacrtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttggagaataaaaatgattctggacatttcattaatcattacagagggagttttctctgtgtccccacaaggcatgattctgggtctatggtgacttaagagggccacacaacaatgagtatttaattttcctcagatgtatggctacaataaacatctataggtaaggtttacattcataaagagacctttttttttccaggaaaaaagacttttattccccctaaatcacaactcccctgtgtctgtccctcaaccctgatttctcttctaaaccgtaatttacaaacccatgtgcaaacccactgaaaggtgagaaggagcataagmcagagacactgggaaccacagccaactacagggggtttttcatttttttgttttgttttgttttttggcaaaataaatcatgattatggctaggaaaatcagggatgtaagtaagcaaaaatttagaaactacatattgcatgtagtccccaaattcagaaacagtcrtcgttaaacatcttttatttagtctttcagatatttttctacatatacctatttgcacatttcacaaaaaagagttattaactgtggacactctttgacttgcattttccacttatagctatcttttggtgcaaataagtaatatattttggagcttgctattcttctctttttatggtatttttgtgtgcacattcttatgctcttattcagttatttctgtagaayacawtttttgaaataaaaatactagattcaaaggtgtgaatatttttgaaggttttgtggtgtggtatcatgaaattaggtttcagaaagtttactccayagttgactttttctaccagctaataagagtgctcatttaccccacttaggccaactctaacaggcttctgttgctttgcatcctgacatatttatctttctggaaacagtgtcctaatttatttctgcagagctactgcctctcagttttggtccatgtggttctggtgaccctgattcttctgctgaaccagaaagtgcacacatcctcctggctgtggtgacccaatcagagccaacgtcttgcaatgaagyttttctttagacatctagaaataagactcttatgttttttttttccaatttgacttgaaacttaagacaatacacaggcctgagttgttggtactattttgctactacgtggagcttgagagtaatggtaacaccaagactggagcaagtggaaggagacatattgtccactgatgctatcagttgagcacaatgtgcagttactttttaagccagattcaccatgggctttttggctcctgaaccaatagatttcatttgttttcaagccactttgtactaggttttccatcatttgcaatcaaaaccagtatacaaacactggttatttaatttttcatttttgctaatctcagggataaaatggcttctagttgttttaacttggctatatttgtgattcttcccattttcatatacttactaatcacttctatttcttttgtaaattatcttttcatatttgttatctaattctttaaaatttgagtactttaattctcattattgtttgtggaattgttaaacaagactgaataatctgcccaaagtccatggacatgggggcccatgtaaaagctttgaaagccaccatcattatgagataaattatataatagtactttacataggctccaaaatacagcacagacacagctatcattgtcatggtcatcattatcatcatgatcaccaacttatgaggataagcaagaacacctactagaagtttctttccattcagcaacaaaattggtgtctttctagtcactcccttccctgactgtcacatagcagttcacagaggctcagttgcagaatgagaagctctgggccaggacctgccattgtatgcatccttgcatgggaactgggggctggaagaggagtgactgcttgataattatgagtcagtcaaaaccaccaactgtctgaaaaaaataggcctttttgtaactagtattgtcactaaaccaactcctccatgttttgtgcatacatgaaatctaggcaatacacttgtattcccaaaagcttccacttgaagagatctgtgctctttccaaatataaaccttaccygagaggtggtcatcttggccacacctcagagagggagagaggcagtcttgttgggttgggtggtcataatggggctcagggccaaatccccagggggtaggatagtgcagagaagatggcactctccagtgcttaataaaatgcacgtggtctaagctgcccactccctcaaaggcaataaaaawtaggtactatttaaattgaagagtaactactgccccagggwatggacaggttgtcattggaatagccatggttaatggtcccagttgacaactgaaatgaatgtgctacctgaacaggaaagcttattaaccagatttcaaagacagtctttcccggtaaatccaaatttacaaattaaagccagtaaagacaccgaattctctaataatatgtggggtgcagtatattttagagctgggaataattccaaacagcaaatagttcaaaatttattttcaatttagcatatgcatgcatttgcttaaactgtcttaaaaatgagtaaaaaayactgtcagtttgtttcaatcatactgagatgaggaacaatgtttagcattgcatgctagaaaaggacacaggattgggagtcagggctgggtgaccgtcacaggactttcactaactgtgtggatcttgggcaagtctgtgtgccctgagactcagttatttaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgtattatacaggtctttgagtagtcagtcagtgggagaagttaagacaacagatatctttttattaaaattattatatgaattatcgcaaattaatttttatggttctgtcacaggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtaaaagttggtatttcattattggagaagctgtttttcaaaactgaatcagttttgtgcagaaaggygtagtataactgagagttcttcctcacacggggttcaaggaccagcttcagcaaaatcccgtcaagtggttcttacaaatgcagattcctaggccacaacccagatctgctgaaccaaagtttcttgtgaccaggaatctgcattttaaacaatcactgtgtttctttaaagtagtagaagctagtcattttctattcaaagcctcaaaatgcttgaatatcattgggctaagggattgtctcaagaaagagtctaacaggtgmacatttcatcygaataaagaaacagatttaactgtgtgacccatgatcacattagcggatagcacagtccaaagaaaataacatragacaagcattttgctgagaatgtaattgagaaagatctagaacttgtgattttgggacagggcagttctaaatggggcctatagtgagccagtttgggcacctgtggcatgatgctatgtatggtgtgtgtgtgtrtgtgtgcttgtgcttgtgtgaatatgtattattaactggaaatttgtaaaagtattggaaaaatagtacttacgattttgtgtgygtgtgtgatggagtctcgctttgtagcccaggctggagtgcagtggcgtgatctcggctcactgcaacttccacctcccaggttcaagcgattctcctgcctcagcctcccaagtagctgggattacaggcacgcaccaccacgtccagctaatttttgtagttttagtagagacggggtttcaccacattggccaggctggccttgaactcctgacctcgtgatccacctgcctctacctcctaatgtgctgggattacaggcatgagccaccgcacccagcggtaattacaatttttattaggtcagagagatgcttattaatcacgagccacagtttcwtcttaatgatttttccttttgattaatatccagagtaagcttttctttgttgttcccatttccatgttcataactctttactcatcttcactctatgtgagtttaccaactagaaattggatagtcattctctgatcccacatgttaaacttgtagagaaaactcagattgtatgtgaggatcatcatattaaaagtggaggaaggttctagaattcttataaataatgaaattaacatgaaggtggacatctaagacagarggaagtcttccattaagtgcagactacaaggagttaatamgcaagatgaacacgatatacaaatccagctcttatcactaagttaactttttaagtaaatgaaagtatttgcaaaaataattaccaattgagaacatagttgcctgaaagtttaagaacacaggaaaaatcattaactctttaatayggttgatttcctgtacttaaaaaatgtgagtgtaaagaaaacgcagtgatggagttagatattatggggtgttataaaattagctctaagagtgttctttccagcaagtattggggaagctatattattttccttattcctggttttatttgttagtgtgtagaaaatgctagacatttcctcaatgtatgtttattattctacttcctaagtaaagctacttttaaaataggtttggttgcttcttgaaagatagtgttacaggaaccctgccaaaagtacatcgaacaggtgcagtttctggacattccttgaagcaatgtggtcatcaaataagtggtaagttgtgaatttcttagctacatttgagttaatattggatctcgcttagaacagcttttgctcaaagtttgtactgctacagctttttggaaggcatcactcataaagataggagatggggcagtattctggacacaaaagagggacccatattcatctggacacttctattgtctttataaatcaacacatacttaatgagcctctattatttatgaggttagcgctcaagtgtaagatttgcagaaaatgaatccaaataattgtgtctcrtttccagataagaatttttaagaaaacacaagggaacatctctctcaagttcacttgagggtaatttttacatcagtgattctcaaccagcagtgattttgtctcttccactggggacatttgacaatgtctggagacatttttggtggctacaactagggaggatgctattagcatttactaagtagaggccagaatgtttgaatgctgaccaacattctacaaggcacagggcagtcgtccacagcaaataattttctggcccaaaacgtcaacagtgctgacatcaagaaactctgygatataccactaggcccaaaytgaagaactgagttctgcaaatcttgctaagaataatacttcctaaaggaaacttgaggactaggatgctagagaactttgattctgacatctgaagctactgatgtcttgggaaacagtttccaatgctatcctaataaatttaagacaaatgaactatttctcaaacatgactgggactgataagaaagtgaaaagtgctgaaaagaktcaactgatgggttgtcagartcttaaaataactgctgttattctatgtatgactatatatcattactattttattttcattatgcacaattaattttgtaggttcaaatttcagatgtttttaaatttgtcatcctttcctccctcattgatatcacctcttcaatacgtacacactttgagcctgctgtttgcattttaaccagttatcaaaggatggcaatgccttcattataaatgtgggcctgacttagccagtataataggtgtagtctaygtgaggwggagtacatttcctattttaaaagatcaatttttatgttaatccaatttggtataaattattcgagtaagtgctatttctgattgttgtatcttgtagcaaaatttaaagaaaaagtaatttgtgcctttctcaatattcctgttattgttcatgtattctaaaactcastgttactcacttagcttgcttttaatgttttttaaagtgaaaaattgttcccaagtacataaaatctctacactcaagaacaattctagtcaaaagcatttagagcttccgtatgaacacttaaagagtttttatttgtaagagtcgcatcccaactcttagcctgttcttttctcacatgcagaaaaataggaaagagacttcgtttccacagtctgcaaattcctgtgtttaagaaccacagtgaataatccacctccctgcccaactcatcgtactgtcatatagttttcctgacagtttgtgtattttctgtctttcccacccttaaatttagttttatgacttcaaccatacttcttaggagtggaaaggtatctgtagtagattatggtttattccacataatcttggggaataaaactttaaaaaagtatacagtttatacttctggttacattacttccttaaccaaaagtctaaccaagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggcgcgcgtgcctgtagtcccagctactcgggaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgakctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgscttgtttatttcccactgctcattgataatttcaaygtgaaatttacctgtattgctgcatgcatcttgcagtttaagaagtgaagtaacccaatttcaaagctagtgctttagggaaaatattggattgtatttacttcaagcagagttcgataatttatgtacataataaaaattttaaatcccttasttaatatagcagttgccaaaactgggctattatcattctaaactaccaacccaaatggtagtgggtatctaatctacctctagaaagaaaatggactgtatttgctctatgtatttttcttgtacagcttgccatcgagacatttataaaggagttgatatgagaggagtcaattttaatgtgtctaaggttagcagtgttgaagaatgccaaaaaaggtgcaccavtaacattcgctgccagtttttttcatatgccacgcaaacatttcacaaggcagagtaccggtgagtacaattcaaggtgtgtgttctttgtattggtgcctccaggatttcactgtattcttcttaacctcttttgttcccaaactaaaaaccaaacagggcttttattctaaccactttcctcatttacttactctattttatttttttatcttttatttatttatttatttattgagatggagtcgcgctctgtcgcccaggctagagtgcagtggcgtaatctcgactcactacaacctccgcttcccgggttcaagcgattctcctgcctcagcctcccgagtagctgggattacaggcgtccgccaccatgcctggctaatttttgtatttttagtagagtcggggttttactatgttggtcaggctggtctcraactcctgatcttgtgatccacccacctcagcctyccaaagcgctgggattacaggcatgagccactgcggcctcgcccttcattttttaattaaaataattcatttaatttcatttgtttctctactcttttcccctggcatgtaattgtaccgcatcttcaaagcctgacatcctcttcccctacktctccaaagctgattcttgcaggtctttcctcaaataccgtcccctccaaaagcccatttctgagcattctcttttaagtcacactcagctctgtttatttcattcatagagctaatcacaatttgatattaacttgtgatttttttccttatttttaaatcttatttttatttgcatagatgtatggggtacaagtgtaattttgttactttgatgtattttacagtggtaaagtctgggcttttggtatatccatcactgsagtcatgtacattgtacccactaagctatttttcaacgcccgcccccttcccacctctctgtcaccttcccagtctctactgtctatcgctccatgctctactcaattttggtgtcattttttcctgaagcaaaattttggtgtcattttttctgaagtcattttctgaagtctgtgtcatttttcgctttcctgaagcgaattttggtgtcatttttcctgaagttcygtttgccccacacataggccttgcttatagaatgagggtttagtgtcacsgagtctcctgcctcattctcaccctaacttttcctttacccctttgcgaggggaaggatgtccattaggttaataatgcasacccctaacccactcattatcagggtcattgtttttccactgtgcattttaatactaactgttacctgcactgctccctgcccctcaaagtgcagaaagcaaagtaacctcttttcttcccattcaggaacaattgcctattaaagtacagtcccggrggaacacctaccrctataaaggtgctgagtaacgtggaatctggattctcactgaagccctgtgccctttcagaaattggtaattgtaggactacttcactttgtgattgtggtaggtggaataggagcccccagagacgtccctgtgctgagccctggracctgtgcgtgtgttcccatagctggcaaaagcgtttctgtcaatggcatgcagttacgggcttcgagrtggggagttkactctggatkttctgaatgggcccaatgtactcacagggttgagtgctcacaaggctcataagaaaaagagagaggcggaaggctcagagccagagagagaggtttgaaggtattacactgctggctttgaagatgaaggtccgtgagccaaggaatgcaggcggcctctagaagttgaaaagggcgaggaaagagtttccctgtggagcgtcctggaggaagaagccctgctgatgtcttgattttagcccagtaagacccaatctctagaacagtaagataattaatcatgtgttgtttttaaccactaagtttgtggttatgcccnnnnnnnnnnnnnnnnnnnnattatgtctgacagaagggaagaaatgaccacggtggccttctcagaccctgtgggaaaggcctctacccatccagtgaaagtgtctacccagaccaagaggtattttagtttcctgactccgggtatgtgagtaaagtcaatctgccagtcctgggcgggggcaaatccccgagcttgatgtgtagggaagggagggggcctgagcaatccctgaggaggagtgagtagcagatggaacactgagcagttattttttgaggatagatttttacgacggaaaggaaaagtgaggttttaagaggtgggttagtggcttgtaacttacatggaagagtttatgaaatgatgacagaatagaatgggcctgtgaggctggaggagatattttccttggtccaagaattatttgccttgtgtgggaagagattgataggtggaagtttcaatgggggagtagatgggagtgacagatgaggaagaaaaaaactggctgtgagggatagaagttggaatgctcgctgcttttttagctaccttatcagcataggcattgtcctgagcagtgggatctgatgccttttggtggcccttgcagtgaatggcttcagcttcctttggaagtaaagtggccttgagaggagtttttattaaagaggcattaagatggagaacccttgtgtagtgaggaaacctccttcagcccatataaccgcatggtggtgcagaatatggaaggcatatttagagtcagtataaatattgacacgtagtccctttgcaagagtgagggcctgagttaaggcaatgagttcagcttgctgagaggtagtggagcggggcagagcagtagcctcagtgatagatgtggaagatactacagcatagcctgcctttgctggtgagtggtgattaggcctggtggaactgccatcaataaaccaagtgtgatcagggtaaggaacaggaaagaaggaaatatggggaaatggagtggatgtcaggtggatcagagagatacagtcatgggggtgggggccagcctaaaacagtaaggtcaagttgtttgaacagaaaggctacagggcgyggtcctggctcttgtgtaagaattttgactgcgcagccctgcacttcggctgtgtgtaatgaaaagggttgggatgagttagggagagctagtgtgggagcagtttctagggctgtttttaaggaatggcaagaggagtggctaaaggatttaggatctttggggtcagctagctttgcttttgtgagtttatataatggtttagtcaggatggtaaaactwagtatccaaaggcggaagtacttaaccatacctaggaagaaaaggagttgttttgtagaaggggttggggtttgggagatgagccagacacartcagcagggagagcacatgtgttttcatgaagaattatgccgagataggtaatggatgaggaagaaatttgggcttgactgaagtaatgggggctgtcctcgaagccttgtggcagtacagcccaagtaagttgctgaggctgacgggtgtcagggtcagtccaagtgaaagcgaagagaggctgggatgaagggtgcaaaggaatagtaaagaaagcatgtttgagatccagaacagaataatgggttgtggagggaggtattgaggataggagagtatatggctttggtaccatggggtgaataggcaagacaatttggttaatgaggcacagatcctgaactaacctgtaaggcttgtccggtttttggacaggtaaaatgggggaattgtaaggagagtttataggcttcaaaaggccacgctgtaacaggtgagtgataacaggctttaatccttttaaagcatgctgtgggatgggatattggcattgagcggggtaagtgtgattaggttttaatgggatggtaaggggtgcacgataggttgccaaggagggagcagaggtgtcctatacttgtggattaaggtggggacacacaaggggaggatgtgaaggaggctttgaactggggaaagggtggcattgaggtgtggctgtggcctaagaacagtcagggaagcggataattgagttaaaatgcctcgacctagtaagggagctgggcaggtggtgataactaaaaaggagtgcataaaagaatgttgtccaagttggcaccagagttggggagttttaagaggtttagaagcctggcggtcaatacctacaacagttatggaggcaagggaaacaggcccttgaaaagaacgtaatgtggagtgggtagcctctgtattaattaagaaggggatggatttaccctccactgtaagagttacctaaagcatctgtgatggtccaggaggcttctaaggtgatcgggcagcgtcagtcttcagccgctaagccaagaagatctgggaagcagtcagtcagagagccttgggccagagttccaggggctctgggagtggcagccaggccagttagacagtccgatttctagtggggtcccacacagatgagacacagcttaggaggaatcccaggctgcgggcattccttggcccattggccagatttctggcacttgaaacaagatcctgatggaggaggtcctgtaggaatgcttgaccactgcagtttaggcattttgaagtttttgtgtgtgstggagatgtggctgggttttgtctcacagcagaggcaaggaatcrcaactcagaaatacattgctacttggctgcctctattattgtacaycttgaaggcgaggttaattaagtcctcttgtggggtttgagggctggaatctaatttttggagttttttgttttttgttttttgktttttkttttttaatgtcaggagctgactgggtgataaaatgcatattgagaataagaggccttctgacccttctgggtctagggctgtaaagcgtctcagggttgctgccaaacgggccatgaactgggctgggtttttcatatttgatgaaaaagagcctaaacgctaactgatttgggagaggtcggataaataaaaaggaacattaatcttgactatgcctttagctccaaccacctctttaagaggaaattgttgggcaggtgggggagggctagtcgtggaatgaaactgtaagctggaccgggtgtgaggaggggaggtgatagaaggattatagggtggaggagcagaggctgaggaagaattgggatctggcttggcctggcaaggagcagcctggggaggaggggagaggtcagatgggtccatagaaaaggaggattggaaagactcagcaacacttggggttgggattgagaggacagatgggttgggattgaggggacagatgggagggaaagaaggaagatttgggacaagttgcattgggaacagagactagggagggaccaatgtgtaaaagaatgcctggacgtcaggcacctcagaccgtttgcccattttatgacaagaattatctagatcttgtaggatggaaaaatcgaaagtgccgttttctggctatttggaaccattgtygagtttgtattggggttaagcagcattgcagaagaaaataaggcatttaggttttaggtcaggtgtgagttgaagaggttttaagttcttgagaacataggctaagggagaagaaggaggaatggagggtggaaagttgcctatagtgaaggaggcaagcccagagaaaagagagggtagagacatggagagaaggggtsggggggtgcttgcccccaggaaagtggttcttgccactaagggtgaaggatcaaggcaggcattcgcgcggtgatcagatacctctgaaacgtgggtgaataatcaagcaggtgtccctgcagtgattaaacagcaaggaaagactatcttcccaagtccatgaccagtgccagagttttgggttcatggataaaacgcgtctcctctgtctctaccagaaaatgaaaggaattgaaattaagagaagggagagattgaaggatggcgccaagattgaaaggaaaaagaggttgagggatagggagagaggttggataagagagtaaaaagaggctgcttacccaatttaaaatcggtgagatgttccttgggcttgttggtctgaggaccagaggtcatgggtggatctttctcatggagcaaagagcagggggacaggggattgatttcccaagggaggtcccctgatctgagtcacagcaccaaatatcacgtgtgtccatgcgaagagaccaccaaacaggctttgtgtgagcaagaaagctttttaatcayctgggtgcaggcgggctgagtccaaaaagagagtcagtgaagggagataggggtggggacgttttataggatttgggtaggtagtggaaaattacagtcaaagggggttgttctctggcgggcaggggtggggggtcacaaggtgctcagtgggggagcttctgagccaggagaaggaatttcacaaggtaacgtcatcagttaaggcaggaaccggccattttcacttcttttgtcattcttcagttacttcaggccatctggatgtatgcatgtaggcttgggcccagaggcctgayatttaacatggataaatgtaaagttcttagaatcatacatacacwttggaaaagatggggcttaatcgcactttataagacttgaaggatgtttgagaatcactatgaaactgctgaaaataccaagaraatttaattcttatgtatataaataatgtgtctgttttacatgaatcccttctacaagcttggtatttaatatggcatatattgttttttcatagtagatttaaaatttttgatatctaatttagataacataaaattaaccctttgaaagtgtacaactccgtggtttttagtatatccacctgattgcacaacgatcaccactgtctagttccagaacatttttatcaccacaaaagaaaggctgtatccaggcygggcacggtggctcacgcctgtaatcccagcactttgggaggcygaggcgggcggatcacggggtcaggagattgaaaccatcctgggtaacacggtgaagccctatctgtactaaagatacaaaaaaattagctgggcatgrtggcagatgcctgtagtcccagctactcaggaggctgaggcaggagaatggcctgaacccaggaagcggagcttgcagtgagccaagattgcgccactgcactccagcctgggcgacagagcaagactccatctcacaaaaaaataataaaaataaaataaaaaaaaaaaagaaaggctgtctttctcctttcccattggccrtctttctccattccctactcctccaatcccctggcaaccactaaatctactttccatgtctgtggacttgactcttcgggacattttacataaatggaatcatgcaatgcagcacattttgcatctggcttttttcacctggcgtgttttcaaggctcattcgtattctagcatatatcartactttgttcctatttaggactaaataagattctattgtatgaataaaacatattttgtttatatacttagtttgatgaacatttgagttgtttctggatttttttttttttttttttgcctcttatgaataatgctgctatggacaacagtttttgggtaggcatgcattttaaattctcttatgtatatacttaggattaaaattgctggatcacagagtaactccatgtttaactttttgatgaattgccaaactgtttttgagagcagctacacaatgttacattcttaccagcaacaattgagggcttcagtctctctacaaccttaacaacacttgttattgkctttgtaattattgcctttctaggcagtgtgaagtggtgtctcactgtggttttgatatgcatttccctaatgactaacaatgttgtgtatcttttcgtgtgctcattttcaatttgaatacattctttgggaaaatctctgtttaaatcttttggccattaaaaataattgggttattttcattgttgagttgtatgaactctttatatactctggatactrcactcttatgacatatattattttcaaaaattttctgtgcatctgcaggtcatcttttcactttactgatggtgttctttgaagcaccaaagtttttaaacttgatgaaatccagtctggctttattcttgcacgtgctttacctaaaacgccaaaacctaattcatggttttgaagatttttgcttatgatttgttcttagaggtttatagttttagctcttacatttaggcatttgatgcattttaaattaaattttgtatatggtgtaaagtagcaatccaacttaattcttgcatgtgggtattcagttattccattgycttgaaacccttttcaaaatcaattgtctataaatgtaagagtttatttttggaccatcagttctatcctgttgacctatatatgcctatcctaatgccagttacacacagtyttgattaccataactttgcagtaagttttgaactcagacagtctgagtgcttttattttgtcctttttcaagattaatttggttattcyggatcttttgcatttccatatgaattttaggatggttgtcaatttctgcaatagaaaagcagcaggattttgatagagagtgcattgaatctgtagaccaatgagtatcaatggaattatgtgttatcaaatttagtaaactacataaacgatatgtacacaactaaaacaaaactaagatataagatcatattaatgtaatgataataaaagtggattgtctcctgttctaattttaataggcaywaggcatttttgttaatcacttcttattaaagaattttttataatattcaggaaaatacaacaaaaaaacccttacattcctaaggcctcagagtcagagtaatataaaggaaatgtaaacacatgctgagtaatgcaagcatttggcaatggtggtgactggagctgggagcacagcttttatttctctgaaataggaatttgccccttagagttagaccaattttgccttcctctaaatggcaaacagtttggagatactttaaaggacattttttcacttaggatgtttagtactatgaataataaatagtcacaatttccttaactatggtgacaaaatacaagcaaattyagcctcrtgtcatttcctaaggaacatcttctctctgtgagttcacaggttgccamatgaacatcttccagcatcttgmgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagyatggagctaagagaagggtgtctagttatgtaatatcatcggcagcataaattcccagaatttgttctttgatttttttgtttgtttttccagttagaaggtggaacttcatcattgtcctcttttcaggttgtctgtgcctattagttttctccagagggagaggtggcttgatttacatttaatctctgcaatttattagagtcctgtagttggatttactttgaagagagtttcccagaagaataaaatttgctgcrttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctstactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgactkttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccarctaggattgcgtatgggacacaagggagctctggttactctttgagattgtgtaacactggggacaackctggtgagtaacctcactttttcgtggwcctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttcttggggagagtrgccctggyaggtgagcctgcaggtgaagctgacagctcagaggcacctgtgtggagggtcactcataggacaccagtgggtcctcactgctgcccactgctttgatgggtaagtgttggatgcatctcatccagagtcttatcttggcttttcattttgaaggatctatgatcagctgcttcaccgccatgtgactttatgaatagagacgtgttaaagcggggatggtattcacaacatttaacttatagggtccragcactgaccaacctgaccattagaacagagtgtggtctctgtacagggcagatggcrctgagtgggtattctccacagaaasagaaacgaagacagtaccccactcctccaacccaccacccaccaccaatcccaccaccaattccaccaccaatcctgccacccaccaccaatctcaccaccaatcccaccaccaatcctrccacccaccatcaatctcagcaccaatcccaccaccaatcccaccaccaatcccaccacctaccccaccaccaatcccgccacccacgaccaatcccaccaccgatcccgccaccaatcccaccaccaatcccaccaccaatcccaccacctaccccaccaccaatcccgccacccacgaccaatcccaccaccgatcccgccaccaaccaccaatcccaccaccaatcccaccaccaatccctgatgtgttcttcaaagacttatttgtcaggcccatagaaatgttacttcttgctctttgattcataaatatactaagtcataataatttttaaaagtgagagtttcktactctgtatatttcaatgtatataatttgatctatttcaatttattggtcaaatagtagacatgttaggtaagtcttaaaatactgaggctttggagttagacagaacatggcttaagtgacagctttgctgcttattagaggtgtggccctagaagatttgtaaatccctctgagctttatttgatctaaaatatgaatagtaatagtcccgaatttgtaacrttgttgggaagattaagtgacacatttaaaatgcttagkactgtgtgtagaacataaacacttcaaaaaatgtaaactgtgatttctatattcaataagaaatgtagmaatggacaaagcatataaaaagcaaaagaaatactagaagacacttgatttttctcaaaaataaacacaccaagtatttttgttttagtgaaattcatgcttacwtgctgtatactaggattgaacatactgccaccaaaatatagcagtcrgtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaraattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttatttatatatttatttaatttattttttgagatggagtctctctctgttgcccagagtagagtgcagtggcacaatcttggttcactgcagcctctgcctcccgggttcaagcgattctcctgcctcagcctcctgagtagctgggattacaggcgcgcgccacacctggctaatttttgtatttttagtagagacgrggtttcatcatgttggtcaggctggtctcgaactcctggcctcaagggatccacccayctcggcctcccgaagtgctgggattacaggtgtgggccactgtgcccagctgtatagagatattttaaacaacactaaagtcctcctactttgactaattagaagagcattagaagatcagcctgacttcttgacagttctgaatttagtggagcaatgaggttcagctttggtgaatgagcttaatttttccatgataaactgctagtttcttcccactayagtgtctctcaaaaatgggacagcaacattctttttgttttcacttgcagtaagcatgatgcaattacataaatgtacacttttcaatttgttaaatagaatcttcagagattcactactgccgctattggtgatgaaaaattaccagaaggaggaattaggtaggagaaaatgtgtcctatgtatttccttcccagttctttgaaagagagtgataggaaaaaggaacactattgaaggaaggactgcccagtttcaaacaggwatttatttttctcycctaggcttcccctgcmggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactggtatgtagcatatgtaagaaggtggagagcagaattgcgctggttgatattttcatatcagtttgaacaagagggcagacctagagagactgtcgtcgttttctgactggtggagttgagggaaacgtgagggttgctgggaagtgaagacyccgcgacttgccgtgaaatctcttctacttaaagagcaagacatgtgaattaattctttcagggagggatacaactgcatgcaggtgatggaaataatgggcgtgggaaatgtctgtgccgtctgagaggcactgggcttgctttgacaagagtagcagaactgtcattgctttgggcttagggatattcgaatgtgtgagggcaagtgggatcagatatctacttccaggtataatttgggtaggaaagaractcatgcagaaagaagccctggaaggccagagcatcgtggtcagaggtgttgcctttggagggtcattgctgccaggagccgaatacccactgtatccaataacattcatggtcaggaatggtggctcacacctgtaatcccaacactttgggatgcccaggtgggaggattgcttgaggccaggagtttgagaccagcctgggcaacacagtgagaccccgtctctacataaaattagaaaaaaacaattaactgggtgtggtggtgtgcacctgtagtcccagcyagtcaagaggctgagayaagaggatctcttgagcccaggagctcaaggctgtagtgagccaagatcgtgccactgcacacaaacaattatgtgacctcgggcaagttgctttacctctttacacctcttaatttccttatctgtaaaatgaggatgataatttmttcctgggtctgttgtaataattaatacatcaaagcacttcmtgtctggaacagtgaagayaccytgctatgactattaaggatartatacatggaataagacacaggaacttctaaatgcttttgaccatagatttaggttctgagttttaagaatttaactcaggaaattgtaacaccaaaaatgtcatgtgaaaaatggtggtgacaaattttcttgaatcattagccttagaggttgggcagaaagcaaaaaattattcttgatgctactctatagaaagagaagacagaaaaagagaaagatgtatttttaaagtctatatccataactttatttgaccaaactctaatttaaaaattatgtttcagaattccaaaaaccaatatgcctaccttccaaaggtgacacaagcacaatttataccaactgttgggtaaccggatggggcttctcgaaggagaaaggtaagcatgacgctttaaatattgcttctagagtaagtctcacatgttgaaatacatggagtgggtcgttttaatcggtttctgtctgaaattatatckaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcayatttttagattttttattggtaatctgagacaagaagaaatttaaagtaatcttcactaagccaygaaagctcccaacattgttctccrtgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagwtgaggggatggcagaaaacatggaagcaaggtctctggtcagcccagggtgctgggcttgtcccaacaccacgtaggcaataagaggacagtacagggkgccgtctctctmcctcttcctctctctgtctctctctctgtgtgtgtgtgtgtgtgtgtgtgtaacactaycttcccaatttttactgtctatttgtattcaaagataaggtccttatgaaaaatacactgctctgattcactttaaaacttatttccatatttattatttattgtgggaataayaatattcccaatattattatttattatttaagttattattattaacttccctctgaggttatatattggttactcacaggtgaaatccaaaatattctacaaaaggtaaatattcctttggtaacaaatgaagaatrccagaaaagatatcaagattataaaataacccaacrgatggtctgtgctggctataaagaagggggaaaagatgcttgtaaggtaactcatgagattatgaaaaacacaataggctgcttgagaaaattcatttcaaaatatattttccaatagcataattyaatcatagtttttwaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttctttrtcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtctggcaagcaaggtcttgcacacacrcagcactttgggaggccaatgcaggtggatcacttgagcctaggaatytgagaccagtctgggcaatgtgatgaaacccatctctacaaaaaaatatgaaagtatctgtgtgtgtgtgttgctgtgtagtggactacagaactttagaggcagtcacttatttgaaycccattgycgtaactttctactattttatttttccactgtgactcagggagattcaggtggtcccttagtttgcaaacacaayggaatgtggcgtttggtgggcatcaccagctggggtgaaggctgtgcccgcagggagcaacctggtgtctacaccaaagtcgctgagtacatggactggattttagagamaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaracacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggtygaggttccagcacagttcctgggatccctctaattgcactgcttcctctggaactcagtatatctcaaagatgtaatttcctctcygtgctgcacctggtcggccactgaaacccactattgccygcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctygaggggctgcagcattgcacagccttcatggcaggcaaggaatctgctttgcaaggggcattagccctggaggctcagtggatatgggctattgcaatagtaattcaaggagcatttttaggcctggcrtggtggctcacgcctgtaattccaacagtttaggagatcaaggcaggtggatcactkgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagratggtctcgatctgctgaccttgtgatccacccgcctcggcctcccaaagtgctgggattacaggcttgagccaccacaccsagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagaggstgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgaccyagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccctgccaaggcatgggaaccccccacgtaaacttggaacttttcctttcaattgttgcttatgtctgtcactttacttgactgtgagcagcttctagggaggctctctcattcatagtgcatatcatgggcatccagtaaacggctaatgatgatgatacacctttattacaaaaataaaggcaatggagactgaagaggtgaaatgattagctcaaggtcactggcaaggacagagctggaacaaagctcagcattcctatgccaggcaatgtcctctcactgatatccggttgcttctcactaggagaaggatgaaagatgacagagcatttataaccaccatttgttattttcattatcaactgacactggtgtttctcygcccggagcgattttgtcctcccttcacctcaggaaacattcggcaacgtctagagacacttttggttgtcctaatgggagagggtatgcaactggctgtagtgggtagaggccagggatgcagctaaacatcctgcagtgtgtgggacagcccctcgcaagagagagttatcctgccccaatatcaataatgccagggttgggaaagcctgatctcatgtcagcattaaaaccttgtaatgaaaagaggacatttcggccgggcgcggtggctcacgcctggaatcccagcactttgggaggctgaggtgggcggatcgcgagatcaggagatcgagactatcctggctaacacggtgaaaccccgtctctacttaaaatacaaaaaaaaaaaattagccgggcgtggtggcaggcacctgcagtcccagctactcgggaggttgaggcaggagaatggcgtgaacccgggaggyggagcttgcagtgagccgagatcacaccactgcactccagcctgggcgacagagcgagactccgtctcaaaaaaaaaaaaaaaaaaaaagaaaaagaaaaacaaaagaggacatttcaggaacagcaagaaaggggttgtaggacatggcgggctgtgccctttctcttcctttattttttactttttgatacattctatttgtacatatttgtggggcacatgtgaaattgtgttatgtgcatagaatgtgtaatgatcaagtcaggatgttggcatacccatcacccaaccatttctatgtgttgagtacatttcaagtccttttctagctatttagaaaactataataccttgttgttsactrcagtcaccctactcttctgtcaaacattagaaagcattccttctatctaactctgtggttgtaccccttcaccaacctctcttcgtcctcaccaccmcccccacmcacacacacccttcccagcctctcgtaaccaccatatactctctacggccatgaaatcatctttcgtgggatcaygcaatgtttgtctttctgtgcttggcttactttacttaacataatgacctccagttccatccacattgctgcaaatggaatgatttccttcttttttattgtgtccattttcaaagcaagttctgaaagacaagagaaggagctctgagagttgattatggccatgcctgagaaggggtctcagtcaactaatgccgttgtggacattcctgtcccaagcagaaggctttaggtcacaatatgtccaaatgtccaatacatctcccacctatgatccattggaaagaaaacaaacctcgggacccccaaaatcactaagccacatggaaaagtaaagctgggaactgcattgggcaaaccttcctcccattctattcctaaataaaatagctttcttaagctataaaaaaccytttttaagctttaaaaaggttttaaaaagctacattcctcacaatttgcccatgaggaaattccttgtggaaaaaggacaggcagaagtcagagtcacccctctgctgacatgagacaggtgcgtatctgattgcctcgtttgccatattgtttcactgggccacactaaggcatgagtgactattcttgtaaattgcgtatttggtgaaaggctaattggaaactcgaaaaaatgcttctgtttgtctcttatctacctatgacctggaagcccccttcccttcttcgagttgtcccaccttttaggaccaaaccaatgtacatcttgcatagattgattgatgtcttatatctccctaaaatgtacaaaatcagcttgggccctgaccaccttggacacatgtcatcaggacctcatgaggctgtgtcataggtacatccttatccttggcaaaataaactttctaaattgattgggacctgtctcagatactttttgatttagaatcctaacttctgacttgtacttgggtctctgcagactaacttctatattcttcctaagactttgtctagttattcctcattttcatcagtcttcgaatattcaaaaacatttcatttcattgaaaaaaaattgaaaaaagtagttgatatcagaattttaaactgcaatgcattagttgaaaataattttttaaggatatctatggtcagtttaaaasaaaggtctatttaatctcaaagagtttctatgtagtcaagacttttattctaggctgggcacggtggctcatgcctgtaattccagcacttgggaggccaaggcaggtggatcgcttgtgcccaggcattccagaccagcttggggaacacagcaaaaccctgtctctacaaaaaatacaacaattasccatgcggagtgacatgcggctgtattcctagctattcaggaggctgaggtgggaggatcacctggtggctgcgytgagtggagatcacaccactgtactctcgtctgggygacaggagtgagaccttgtctgaaaaaaaattattctacttttatttgaatagacaaaatttttttgaatcctgatactatttcaaagaccttaaagatttcactaactagctaaatcaaacttaggaaaatattatttggttttccagtgaagcatttctcttatttagagcctttctgtttctctcaayagggttgragagttatccttatcttctttttaytggggcttaagaagagagatgaggttccatggagtaaacaatwcaaggatataaggacctcatataatctcacgtatccattttccatgaaagccattcttggcacgaatttgccattctatgtttgagcctcataaaaggcaatgcatcataaatatgcactttttgggtagctggaatgtactttaaacgggaaactcaagaaaacagctaggaactctttatgccaggataagtcaaatgcactggcaatagatcaaataaaaatatctgagtaaatgccttccaga

SEQ ID NO: 13204 - DNA, 321019 bp, Homo sapiens
  misc_feature (1)...(321019): n = A,T,C or G, or insertion/deletion polymorphism (see Tables 1-2)
gcacacccatctcagagactaaccaccgcaaatgacaagtgaaaaagacagagccgttacagctatcctggtcgggtttattttcccagactaccatgtggggagttgaacatacccaccctcaggtcggggacaggctcgtgacgatgctcagggtagtggtggagccccagaagcctccagtttccattttggacccacggagatctccaggktgcctatcactcttggcccaggcctgggctttccaggaacttccccgattgatgttttactgaacgtggtgccgaaagttagtcacaggaagacattatctcagctgtctctgcgcaaatgctctctgaaacctccacgttgcttttaaagcatcatggagaaatgtagcatttatgccttgggagccagctatctatgcagagctaaaatagaaaatcttctcaagttgagtataaacagatcctcaacaagactgagactcttgttgcttgtggctgtgtggggataggaatcagctacagcatcacttgtatttttcctgcccttggggtgctctgtggagaccatgtgatgccttccacagctaatgcccctaaggaaagaccttaggcagatacacactgaaagtatacacatctgtagacagctgtgggcaaggatgttggagtttagcatctctactaactcacctaatagtaaaaacgggaagcattgtgctaacattttttttagaacagctgcaactatctaaattataatacaatcttaacaatttaacattcagatacaattatgcagaatgaagtgcacccatcttaagtgtacagtctgatgtgtttctgctaaatgcatatactagcatagccaacaccccatcaagatatagagcattgccatcacccaagaaagttctttatgcctctccctagtcatttgaaactttccctctctacccacccagggcagccatgattctgatttctagctctagatcaatcttgcctgtttttgagctttacataaatgagctaatacagtatgtactcttttggcttatacattatgctttggagactcatttatgtttttgcatggattagtagtccattcctttttactgctaagcagtattgcattgaatggatatatcatgatttgtttatccattctccttttgatttacatttgggttgttttagtttttgctattatgaacaaagcacctattgacattcccatagaagtatttttgtggaattttcatttcttttgggtaaataactagggctagacttgctggatcgtaagttagttgtatgttttaccttataagaaactgtcaaacagttgacataatgcactcttaatgaagcttattacctgtgaagtgaggtcttttaaattttttgtcttttgatttttgtcttaaattgcatcgatattagatgtgtggacattcttctgaaatatcttaaggatcagaccttgattaactgtgttattttagtagatctttaatgcttctgagttatttatacggacagctcgaaatctgaacgactcccattggaaaaccagaatgatctctttcatggatctctcccatatttttatttatcttctttaatgttttatacatacaaaaatatgtagaacatgtgttagttattaagcatacttataaaatggaaatttgtaaatccgtcactcaatccaagagtgaactcatttccaaattacaatggaaacccatgtgsctatgggcttctcatcctctccaaaggaattcacatccttcattaattcttttgctaaaacaaaagcaaaacaaaggaaaaatattattttattatttaaagcaaaaaaaattttctgtaacttttaaagttttccttgctttttaagagctttatcaaaatggtgttacgctgtgtgcgtttttgatatttgtatatttttactcagtgtgtttcaaagatctgcccatgttgtgtggggctgtagtttattcacttttgctgctaacattccyttctgcgaatacatcacaatatactgtattacttgatacttgtcaattgttgtgctgtttctcacgtttgcacttgatgtatatgatatacattacattttttggggagtctggtacatttagcagaataatttgagatgaaactgttatcaagtaaacggcgtttttaaaaaatgaaaacaagcaatcagtttctgctccaaaagagggagaacctataagatacctgagtaaaatggtataaaataaaaagtttggtgcattgtcaatgtgggtataaagcaaagactccaattaatttttgtctacatgattttatttcaaggttgaaaaaataagtttgacttgtgtatgtaaaatataatcattgaagaaatacaaatcacctcctttgtccatgtggtcaagttagagcgtaaagacaacctaaatttttgttccttttttttccctaaatattaagctatataatgatacatctcccacttcactgtttaaaataacttaatacgattgatttcctactacttcaggaaaacacaaacatttaaaaaattcacaaataaaaatcattttagtaaaaaaaaaacacacaaaaacaaatcctacaacccctacaacaacctatatacatttaaaaattctatagacctctttatgttcttggggacaaataaacaggcatatttattactaatactaaaaatacattgggtagtatttgaagattttatattagcactagccttttaaaaatcagctctaaatttttgtcttacaagtatgtattaaaaattctgaaatcaagtataatgaaattatatatcaatattcctttgcatttaaytccagagtggatctgcaggaatcaagaccaacctcatgcagagaacttaagaaatatttaaaaattagtagactggactttaattcttcatgtgtagtgcctaatttttaaataatacattttaagattctaataaatttatttcactgttaaatctaggaacatccaaaactgaaactctttatttaaaaatcaagctgaatttcagttaaacaaaaccatcccatcatatgaataactttcttaggtaaaacaaggtttattttctttctatacaactgactctgaattgagctagaaatttccaaggaggaaaatgatctaggaaacaactttagaaaaaaagggctaagtttccgttatgatagcttttgacttgttttcagctcttaaaaaattatttacgaacgatggatacacgttctaatgcagaagtattttagaattagagagtaaaagaaacctactaccttcctttacatcaggtcccttcttaccatcctacccgattgtttgagacaaccacttcttatctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggaggacccgagacaggtgcgggtgggtttccgcagtagccgctgatcccgagtgcatgcggcgtgttcccgggtcgggaccgcrgccaagggaggcttcccggccccagcctccaccccctcctcggcgccccgggacccggacacgccccccgagcttcggagacccgcagcgtgcacgcgccccggccgctccccgcagccgcccacgtggtggagccctgagctgcgcgaggccgcggagagcgctcagggcgggcggctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctgggggggggggtcccctttctcccaggtgcgccccttccgccacgttcgggctttccagtacgcagcgaaaaaaatgccgcatgcacgcatttatttattttgcaacagctgcaakaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatggggggcggcgcctcgcagtctcgcgccccacgcccgggctccgctccgcacgtcttggggaacccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttycccccttcctgcctctccgggtttgaaaatggaggccgacgacgccgacagtccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccrtgcgcamgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgagggggsaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccrgggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcakatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttttgtgtttttaatgttctgaaattcaaaacagyagggatggccttcgccgacgcaggagtcgggcattttaaaataggctgtttttcttttggagcgttcttcttgaaggatattstttgtgcaagacggcgatttttgagaacacaggcagragggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtgragaaawaaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctaraataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccrcccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgyactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattwtctttaaaatcattgtttgattaggctttttgcacattgaggtgaataaaaaaaattagaactcctggaagggtaatttgtgagtctggccttgtgtcaagatcacctcatccctgtrgatggagactttgttccataagttccctatagataagatgtaatgaataattcattggcaccgatttatgtctgtagtgtgcttttaaaccctcytggagctgggttcctgaggaggaagcatctgcaggctggactcggctgcctggtggtctccggagtggcctggtgcagagggccagggtggcatctcagaaagttgggtgggtagggtrcttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctcyccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtggnnnnnnnnnnnnnnnnnnnnaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctccctctctcccacgcatggaggcatgttggaaagggagctccaggcctcagtgtctctgcctgtgattggaataacactgctctagcagggatgccaatgagaattagcaatagataatgtatccaagctgcccagcaaacctggcaaatagaaagcatccaataaatggatgcttttctctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttactgcaacctcttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagygctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttsacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaagtgtcacccatcttggrggatcgttaccaatacttcatgagtgaatacatacacatttcttagaacctagggtttataaacactaggagttagctgatactattgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtctttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactscctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcraaaccccgtctctacgaaaaatacaatacaaaaattagccgcgtgtggtggtgtgcgcctgtagtcccagctactygggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcstgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgatkgctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaatttttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgacyttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaattyattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagrggcaggatcttgytgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcrgttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctccyragtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattstgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttttatccttcttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcrgtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctrtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaaraaraatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggkgaatttttaaatttttgtagagatgcggtcttggtacattttctaggctggtctggaagtcctggcctcaagcagttcttccacctgaacctcccaaagtgctgggattataggcgtgagccactgcrcctggcttatttaaatttttatgggtatgaattcacttaaaagctgaaggttttgagaggagagrgagcatrtgaaaaaacctaaaggttttgggaggaggaggagaaggaagagagggagcatgtgaacaagagcaactgatkacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaascatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactyggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaaktaaaacaggaggtaaggagtaaacatgccagkcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctaytctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggktttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatggttagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctrtttgccccactgacatgagggttggatctctagaagaggagtcactgttcagaggttataggcatttgtattttttggcagatgttgtccttcaaaatggctgtacacatatgctcctcccaaaagtaggagagtgcctgttgccccatgtcctcactcaagcttggtgttattagattggtaatttttttgtgtgtgaatctgttaagttaaaaatatttctttctttggccgggcacagagtggctcatgcctgtaatcccagcactttgggagtccsagscgggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccwkcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacytcctgttttgtttgttttttgagacggagttttgctytgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttctttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtrgcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacrtatgacataaaacttaccatcttaacttttttttmttgagacaggwtctcattctgtcacccaggctggagtgyrgtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctccatccaggttgttgcatgtgagaggatttccttcctgkgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcaygagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatrcttttctttagcccttctcatattaacatttagttcttagggatttattttcaaaatatatatagcttgtatatgccattcacctaagttgttaragcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaractcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactargtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaagggaaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagygtgctgcacagggaggaaagacrtggggcagcattgtgggaagagcaaccaagattctcataggcttgggagcrgaagccctgaggtctgttgctggactagatatgtgaggtktgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtactkgggattattaaatcctaaaaaaggttatcacaaagagttttcttggtgtgtgtctgtgcttagaatttagaaaataagtcatccagtattgaggccattttatgaaaagcctttaaaatctgcaaatgcrttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccktcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttckctctcatcacccaggctggagtgcagcggcgcgatctcrgctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgcyygactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacaygtcaagggtgtgtgtgaaatcgttgagcctactcgattttgtcgtgctgttgcgyggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcacttttttttttttggagaaagagtcttactctgtcacccaggctggagtgcagtggtgcgatcttggctcattgcaacctccgggctcccaggttcaagtgattctactgcctcagcckcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtytccaagtactttttaaccyawtgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctrgttggaatgttcccctgactyggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttaytgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtrtttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggrttgcagagaatgtactgagtgtgtttttccactcacaaggaaagacagcagctgaatgcagaagtgtgtrtctggttctaactctttatcacttcagggactgtccaggcagcaccatccgttggrtctcctgcccttcctcytcccacccctgccttayccctggccattcttttgtgaccagtagtcstttatgaatggaattctgagaatgtataattttctcagaagaatgcttctttagctcaccaaatatttcttgtttgctgaggggggaaaaagatcctccttggaaaagtcactgggtgccaaaggtgggtgatkaggagagatgaacttctgggtgtgcctagcaaagctgtttctgttgataggcrattaayaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaaygagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattggraagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcastatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtayctgacaacgtctcacgctagaatgagtttcgtacatgtttagttccctctctytttattccacgcycccccaccccaactttaaatcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacaygaatgggcaratgaaggatttgtggcaaagaagatcygccgaaacaaataagtcatgtaaatgggcagagggmaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagattttttttwaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacakttatgaagcaggggtkactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtactkcttacatggtggcagcaagagaaaatgtggaagaagcaaaagtggaaaccctgataaacccatcagatctcgtcagacttattcactatcatgagaatagcacrggaaagaccagccctcatgattcaattacctcacctgggtcyttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcrgatctggcctgccgactcaaagtaaatctctcttcccctttatttcccatcaaataaaaaaggaacacgaggtagccactgtactcactgaagatgcattgttttttttttttttttttttttaagcgagcagcagcaagatttattgtgaagagtgaaagaacaaagcttycacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacaraaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagmcgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcasagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggtttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttcttttttyttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcrtagccttcctagcaactcttaggcctgcrtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaattttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgygtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagctkttttttttttttttttttttttttggtaacaagatacctatgcaagctgaaaaactcttggctttttagtttgtatcacttccagaaacttttagatgctacgtatagaagtggctttcttttagggttaggtaagatacttccttttttggaaatagttttgccatttggtctcgctgcctgatttgtgctttttcttcttcagcaggtagtrggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcytgaggtgtggagatgcttgtggyggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgscatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacaygagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccttgtttgatccttatcaaaccttatgagaagaaactaccattctcctcatttgatggatgaggaccctaagccctggagaggccaggaaacattcccagagtccctcaggaggaggactagtgctggkctcctttcctcctgttctgctgcctctgagaggagccaggattgaatcgtagccttgtcctctgacctggaggtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttgrtattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactaytcaatttgtcgttgttgttgttgttgttgttktttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcargggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctakggttcctctgtgcagacttgtaracagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagcctttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtmaytctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaaaaaaaggcattactgccttgttcctgatttaaataaaaaaatgtgttttaacaaggaatatgttaagttttggtaaatatagtttatcatatttaagttgtgtatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgatawtctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgtttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagrggatttattaacgtttacttgcrtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcrattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaastgttgtccctgccaggacagtctttgcctctgtaartatctccatattcctccatcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttcttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaartatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgwgcctgtaatcccagttactcgggagrctgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcmttagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccmtgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatrtattaaaacatatggtttttagttaaaataggatgttaaaggaatagagcgcacgaacaaaraactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgmatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccararagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagwtcgagaccatcctggctaacacggtgaaaccccgtctctactaaaaatacaaaaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaaacaacaacaacaacaacaacaacaamacctcacaaccctggtctcccagagcttccatattaataaatctagacaatgtgaaatgcaaatccacttaatatttgatgcaaaaaaawtttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttktctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccrttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttcyatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagayattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttasctgtcaacaggcaacaatcactststctcaggtccctcccgctccckgccgtgtcctggttctacttgccggcagggatctaagttggaattcctttccaacatggaatcctgagtgtccaccatgtcaaaattgtgtcaaaattcrtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctmtctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggygatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaaatttaaggttacggttaagtttggattgtttgcttattggtttggttattggcaattgctacaaagtccagggtgttctttatcagcagcatgcttatcaagttactgacrttcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattrttattattattattrttattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagycattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaaycagatcaagttctctctctcctgtgcttagaaatgctgcctgttaagtcacgttggctacagcacccatctcagatcccttgtgattcagttgtaaagtagattcttctgstctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtggggkggtggggggtggtttggggaagggagtggagtgatggtttcacttttgcaagatggaaaaagttctggaggtggctggcggtgatgttgtacaacagtgtgaacttacttaacattgctgcactctatacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcytgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctktttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttytaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtartaagtacttgactgaatttctgctatttatcaaatgctttttgaatagaaataatgagttaataacatttagcctttttyggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttgagatggagtctccctytgttgcccaggctagagtgcaatggcgcagtctcagctcactgcagcctctgsctyccgggttcaagcgattctcctgcctcagcctcccaagtagctgggattgcaggcacccgcaaccacacccgggtaatttttgtatttktagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatttttattttggccaactctgaccccttaggttgatgtcagaatgaggtgtaccaacctaggtggtcagagttggctcaaaatacgacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaatttttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttgrtgacgacattctgtgagccagcartgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctstststgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttrgaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttytaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacytccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccaggsccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatrgaaggtagcatgtttaacgtycctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaggtttcaggtttgttaggtatgcctgacagctctcttatcaactcccatttatttgctaatctaaatgaaagtttgatggtagagtattgtaaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatgrtaggtrgttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggscatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgctkagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaataaagattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggytaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacartayagccatccatggcgtgttcctctggagtgtggtccgtgccrtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatkggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccrcctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaamaatgatttccccaaattggacagcctgggtttgtatccttgagcacrgttttgggaagagcattctgcatgaggcattgtagctatgtrtatggagtataattctgttttcaggttgctctgccacagaggttaagaactccctcttccaaggtagacattgagaacagagacgaccacactgggttttcmctgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatmttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatgsctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagwacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttstctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggacmagtttggggccagccccccagcctcmcttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagyaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagwcagagtcttactctattgcccaggctgatcttgaactcctatctcaagtgatcctcctgcctcagcctcccaaagtgctgggattacaggcatgagccactgtgccctmtgtaaaagattcttatcaacagttaaaataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaaygtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaamcttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcrgatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacytgttctttgtttcagrgttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaaytgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgygtgttggagtgttttcgaaatgcagagaaattcagagcttctctagctttggctagagaaggaacaatggaagtgagtcttattctacctaagtttgrtgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgyagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcayatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacrttttgggtgarataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagygtagtttgggaagtgtgtggtggagaaggcagatgggrcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatmtaaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctsgccctacctsgaaggcccgggcraagttttcctgagtgtgtatactcatctctttrtgttrtctctggcagggagcaagtgagtacaggattggagtaataggcatttttaggcttgagatggctttgtgtgtttggttaatgtcactacatttcctaggggatartaaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcytsttattcattcgctcatccattmatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacamagttgaatcatgargtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttctccccaggtygaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttyttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctyctaagacttgatcayctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgytgaaataatctaaatatttaaaaaccaaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgtycacatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttaytcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccytttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagratagtacctgacatacagtaagtgytgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctccctcctcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccahtaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgkgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggytggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttcccccsactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatrgcaaaayacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcmtgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccmacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccwttaggactgctgagtctttctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacamccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcayacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaycatttttatgtctccatttctgtttaatagacttatttcagtaagaagagaaagccgtctccatcagcmcctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtarcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgtatccttayagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaaytgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtrtattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaamcaccacatrccgcatgggtattacacaggacctgtatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgyattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggyaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttaracccagctctcaagcaagcmtccaagttgttccggtgaaccygtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaartatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatrtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccasctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttycccaaaaaatttgctactcttgaggttctgtcaaaraatgtgctgtggcctctaraagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaccaacaacaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaraaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatawtcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtstcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcraggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacatagrctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagwgwgwktgtgtgtgwgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggwgtcattgagagccaatcyttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggmccrgggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagmgtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaagrggattctttttctagtgtattatttggagacgcagcttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctytactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatrgatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgccsactctcatggtacttctgatgtttaattmttttggctgtgtctgcatttcctcrtttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagrgatgttatcacccttactggattttgcctcatcagtcaagggttgcgtgtctgactgtgaccagtgagacggcagacgggggtgcrcttagggcttttctgccaagartgacagcagttggtctggagtgctcacctccctgtgaaatcattgttcgcgcgaccctcatctgcctcaggatgctgtactctactacgcacaactgctccatcttttaagatattggaagtgagagcacrggaggagcatgggcggttcgttttgttagaaagaaaccyggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacmtagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtrgagacggggtttcaccatgttagccagkatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaaccyatgagcaagaatgggctwatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagsctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctyctcccccacacctccagggactggagctggggctgctcagaatgmaagatgaatgggggagggagaaggcccrgggttgaccccccacaagcttgtctccctgtctcatgctgtctcctatcccatcatgctgctgattgggcaggatttacttscatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgtactgkttataaaactttaaggtctcrtatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcrgrgaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaayragaaagccactgaggaagcccagaagggaacttagcatatacagccagctttggggaagggggaagcagtgccaagcaagacaggtgcttttcagagacacatgaatctctgtcactcacggatgtactctttgcmccaggtgaaagtgacrtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgytttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataraagtctaattgaktatttgtttatttagacctcccattatagaaagtgtgacatgctgggcctctggggaagatttttgagggttttgatgtcagagccccgaacttyctcygaayttaattgtctttcagaccctttaagaatgtcacagagtatgatgggcaggatgcctgcggctccaacagctggaacatggtggacgtggacctcccgcccaacaaggacgtrgagccyggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattraaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagygatatccagtgaaggtgtcycctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaayggcaacctgagttactacattgtgcgctggcagcrgcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtrgaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttygggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctstgtcacctccstccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccraagccctctgctctccccttccaggttctgasctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagagggtcrcaccctcatgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcacycgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctcygctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatayattgtacatgatgacagtaataatgakgtattcttaaaaattgctgagacaatagattttaagtgttctcaccacacacaaaaaaatgtgatgtaatacatatgttaattaggctcattcagctgttctacaatgtatgcatatttcaaaacaataygytgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatayttctttcttcgattaaaatacttctmattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgkgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgygtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacrtggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttratttattcggcctttgagaagcacttatagccagtttcctcraggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccrctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacataygtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttwtctttctttccaacctttttcctttctttctctttgttttgccttccttcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcycgtccgctgcctaattgcctgtccacrctgggcaccaccrggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaycagcaagggccaccctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagygccactccctccccgaagctttcctgccccactccagtagctatctyctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccstctctgtgtctctstcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgyaccaccaygcccacctaatttttgtatttttagtagagacggggtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgyggctggctgcctgtggtcctcagacagcygctgcaggttcctgggcctcagtgtcctcaatatraaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttcygtaatgccsacagaaaataataatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatstccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttyaggagattttgacttgggaataaarctcactgtccaaccttgcattcatccctccaattttyctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgrgcacatggggggaactcagtttctccccactgcgcrtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcytccaccttagcctcccaagtacctaggaacrcaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttarcaaatctttygtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctamtgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcrgagttcagtgtgagacgcrgtgagtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgctccccaccctgctcccgcccytacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatgatatcccgcacttagcccagggcctggctcgctgtctgacaagyactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcrcctcccttgccaggcrtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtgggrctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtyacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggtyctagcatgggagttctgttgytacaagacatgaaagaatggcctccgtttatcccggagaggagagtccctgagcccttgggagttgccttgaaacctctgccgggtcccagktgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggragccatttgttctgctgctaacacttccacagctccacrtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcrcacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaarctgcttcccagcagggcaggaattccatttgagtcttgtccctgttccaggagaagggctgggtatgtgtcccccaaaggggagagcattcgagaaggatggcgccagcctccccagaactgacctgtggttwaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagyttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactscctcgctgcctggcacctagygtgcacatggcattctaccgtggggtagacttttaaaattctggctacagagatacttttccataaaagtggccacatggaactctccaaatctaagaagcayactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcaygtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactyggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttgggaaaggagagtttgggttttgtaccrtggtggttytgggttctgrgggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtssggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatcygactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcrgtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttyccttgcctttgcttaggttgtgacacacwtatatatatatttktttaattcttgggtacaacagcagtgttaaccgcagacactaggcatttggattactatttttcttaatggctatttaatccttccatyccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgkgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggkcattgggtttgctccccttgctgctgctccatcccygcaggaggctcgcgctgaggcaggacygtgcggccatggctgctgyattcattgagcacaaaggtgcagctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaawtttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattct

SEQ ID NO: 13205 - DNA, 42419 bp, Homo sapiens
agctgcaaatgtttactgggccttgagcgcatcaaatgtgctatgtcccaggccgtactcactattttgtcctatccctgccaccccaaactgttcatcccccatcccagttaatatgctcccattcactcatttccttccatgttttttctctttttaaaaaaactctaatcccataacagattacacccgcattaaaaaaaaaaaaaaaaaagagtctcattatgttgctgaaactggactggaactcctgggctcaagtgatcctcccacctcagcctgcagaagagtctctgcccacccccattttattagccatttatatccattcaaccttcaaaattcattaaatctgctcctctccaccatccccatacctctgccttgtacacatctgtatcttctcttgaatagactccagtccaccttctcaatatccccagagccatcatagtgacctttgaaaacacaaatgtgcctcccttcctaaaaagtcattagtggttttacatcatacacagaatagagatcaaagttctgagcccctgttacaacattgcatgtttgtccaactgcctagactctgaccgccaccaaggcagggaaggtctgcctccgttatctttgaattcccagtaactgcttggatacacagaatatcatcaatattaagtgaattactgaaagcaggcagaggaaaagtataaaaagcaacctagttttaaactctccctcatgcaagtttatatgatgcaattttctacaactctcaytaccagctcattcatctctgctctgaccatgaatagcaaagaaatagaaatcatattttatttgacaattaacaaaagacatatcaaggtgggtatgtggtctcagtataaatttttttatactaggtcctgaccctaccatttccaggtgtataaccctgggtcagagacttaatctctggcctcaatttcatcatttatgaattggggataataatagtacctaattcaaatggttgttaaatgaggcagtgtgtggaataagaagtgctcaataaattatacctgtagttgttacttcagcagaccccttcattaagcctgtttcattaaggcttctaaaaggagtagaacgtacggttcattcatggagaactacaaacaatgctgctttggacaatggaaaacgtgcatgcatttcctagaagaggatgtaacatgtctttactttttccatagagttcagcccatccaaagtcagcctcacatggaggttggggagtttttgtatctttctcttcctgctcccctcttttctcccagtgttttcttcctctctgtcctcttccccagggttcaatggctcctggaagagaggcagcaaagcctatagctctccaaataaataggcttgggtctcatggggacaggcaagccaactggcctagacgtgaagtttacaaagagccctaaatgttgactttcaacattatctcacaattcatttattcatacatcacaaagatacagtgacacaactgaaaaaactcattcattttaaacttgagttccatgactggaccactcttcctatagcaaaccaggaataaatattttttatgaattgcataattattttgtaactagcacrttacattgtattttatctctgtttatgaatttgacctctacaaacaagttaatatcattcaacctattatttgaagatgttaatttgttgaacataaatattaaaaaaaamctttatgtttctgttatgccatttcttcactttttaatatgttggaattctcagaaaacggcctggctgtggggaggtttcctttactctttgagaagccacggagtgaggcatctacaaggcaaatctttcttttgctgataataaccatctttgatagcatcccttcaatgcatttttgttccctttttaaaacagaagtaaggagaagaagggataaaaggaatatggagggccgaactccctgtcacatattatataaaattacaataatcacgagtcacctatttcacaaattactgtgagcgttacaattaagaatacactgcaaagaactttaaagagttaaaagtacaattatgaaaggcagtgtgctccagggaccatttcagtctgtgaactctttgtttctggtccatggctagttaagtataaaaaattgaaagtaagcatttagaaactgttacagaaatttgacaaagtaattttatgtctgttgaaccaaataataaaagatttgggcttgtattttgtatgtctggtttttttacttcctcttccagtaagtcattttcattgcattttacaaaggccaagaaaaacctgtccttcactgcacatagtttgagaagcactgataaaaggtattattatttctgaaattttgcttaaaaaaccacttaataaccactaaataagtcagaagtcattatttgagaaatactgtttcataccaagtataaggagttgccagcacacaagcaagttccagaacaagtttgttttgtattgagtaacttggttatttggtagtcagaaaccactttccccaggaaacaaacgtaaaccaggggttatgttcttggtgtggcctatacatcctagttatctcaaaagacagctaaactatactatacaatgtaacaaccactataacattcttacaatggtttctgatttccaaattagaaaatacgtctcatctccatccccatgtgaggaatgacaattccagccctagcatggtggtggggctgggggtaaagatggatactacttctgcaaaagttgcttcaaccgcaacattcagaaagagaaagaatatgggggtagaagattcctcacacagattattgggggaactcactggtcatgttaataaagttaaaataaggtttccatttctcttgattctctgagggtgagcttaggtaggttttggtggacttgaaagtcctggctcattatcacaaatgcttccatgctaaatcccaaggtgttgttcctcctgaccacccagcaccaagatggcaaacaggtttcatcctgaactgaaatctgttccctagctcagggattcttatttccctttygttgttgttttaaaaaattgtgaggacaagtctgggtgtgatgagacactttgccaaaatcaattagtgacgcctaccatgggccagggaagaaaggaaagtcagcacaaaagctggttttggttgttgttgttgtttttgctatcctgagactagcctaaaagatgtagacctccaaccctttaatgtcacctggaaccaggttgaagaacatgactattaagaacatgacttttttcttttwaaaaaattgggaatagcaaaagggaaatagacagagaatagcatatacttggatattcttrtttgccatctatgtggtttcctcattttgcrgaacttgtggaaagacacggtagcctggctcctgacccagaatccatgaggcatagttgtatgtacttcccttggggcctaagagattaagagagaagcccagacaatagtccaaggccctctgctttaggtctttcttctaaattctgattctttaatttttttttttttgttaattttaattttttttttgtagagatgggttctccctatgttgcccacaatggtcttgaactccccgcttcaagtgatcctcccacctgggcctttcaaagtgctgagattataggcaagagctaccttgccaggcctaaattctgattttgtatctgaggctcttctcttcctcaataattgacaccaaaaatagtcctagaaaggagattccacccttctctaaacagtcatagccttagcctatgtcagagttcttaacccagtggtccattgatagttcagaggaattaatgaccttggataagaaaaaaaaaatcttgatttcaaatggaatttagcattttcttcaattacaaaactagcagacaaacctcagaagcatttgcagtactygtgactgttactaatggaaataacagttattttcattatttcattatagttgttttcagtatcatgaaagaacatttgcactcctctttatttaaaagaatgttgctagatcttgttatttaatatgttaaataatgwtgcacacattacattaccacattactatagcaaaaaattatgttttagatattttaacaattacatttcaattgttgacctttaattttaaagctaaggcaaaattaatgtaagtagagagtttatttgggccaagtttgagtactgcaacccaggagtatagattcaagtttccytaaatatacactctgattagcagcagttacacatagatttttaaggggaaggaagaggcagttcctaaattccttgcgttaaaataacataagctgtggattggttatactttgttctttgtatcataaattccaggaatatgaagataatgggtgggacagctactcgggaacaaaatgtctttaaacaactgtccccaggcatgggtattggggcgtgactgaagtcccatactcatgtygctctgggcctgataaattttgcatacctcacaaagctcagactgctctcagctattttttttccttacaatgtaattgattttctttgcaatctatacattttattcatttatttaaaatttttttttcttctttctttttttcatgaaccgcacagagaaaatttatgcattttattgtaagcatttataaacattattctaagaagttatccacaggctcaccactgccagaagggtccacgacacaaaaaaggtaatgcctcatgggctttcaaaggacaactttttacttctctttctaccatccagtataatccaatatccttaggactgaagcagagatacacacacacacagggagagaggtgtttgtgcttttttttttttttttttttttttggkgagaggcaggtgggaaattggcatccacttttatttactggttctttataaaactgatatttgttgaaaattgtcaagtgtgaccatttctgcctacatattgtagggtggcaattaaataccgaaaaccattagaagcttatttcagatgtactcatttattgtaatggtatcaatcttgatgggtaaatttcattttacttttaaaattgtattttaaattattccttcatgttacggttgttagagtaaaaacggaaaagaaaaaaactacacttcttccctttgagtttggatgaaaaagacgtgtctaagtccttaagtctgtagtctggaagtattaatagaggctgggcatggtggctcattcctgtaattctagcactttgggaggctgaggcaggaggatggcttgagtccaggagtttgagaccaacctgggcaacacagcaagactcggtctccacacacacacacacagacacacacacaacttacacacacttagctaggtgtaacggtacgtgcctgcggtcccagctactcargaggctgaggctggagggtcccttgagtccgggaggtccagactgcagtgagctatgattgtgccaatgtactccascctargcaacacagcgagaccctgttaaaaaaaaaaaaaaaaagtattacgaggcacaggatgtttatttattcgcaactacgtcctgttataaaaagtagtgattccaacgtgaaatatttacacgacgcatcccgttactttccctcccttggccaccgacccccatccccaaaagctgctttctatgtaagtttctcactggaatagcgagtgagaaatgtgtttgaagactagggaaacgagaaaggtatgcgrgctgctagagggtttcgggtgggttgtttgaaaaaggaagtgaaggaattcaaagtttcacatcatgagcctaatgtaaggcgtgtccgggccgtcccgaaggtatctggggaaataggtttgtgaggacaaagaccagggccaggcccagggcggagcctccgcggccccgacgcrgggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcaggtaggtgggactcccgcgcgcccctcctcggcggtccccaggctcggggtggccgcgtggtgcggggagggcgcaggctgggggagggattcctgcgggacctggccctgcggccgggggtggagaatttttgaatgctgtccctcccccagctagttgaacccccatcaccccgactctccgcttcyagtgaaaaaactagcaaagtttggagtgaatcgcgacactttcttgaaagtttataagcccttgctgctaacaaagttctcttctgcttaggctgacaagagaatgctttgcaattacccaagggccaaactagtggtttaaattgaaaacaaaatgactactcatgcattgaaaccttaactatgaagatttatttcaggtcattggtgctgtttctccttgttgcccaaaccagacccgtctttaataaagttgttctccacccatttctgcatagtttgagaaactcttcagctgtmgatcaaagacacttgaaatattcagctactgttcttacttcctatttattcaccagggaagcctgaagccagaatgccagacagcgcagacactattccatctcgcattttagttttaatgaaaatctctggtaggtagacatcatcgtttataaattaccaactcaacgtttgttttttgtttattttattttttgtagagatggggtcttgctgtattgcccaggctgttccctaactcttgcactcaagcaatcctccagcctaggcctccccacagtgctgggattacaggtgtgagctgttctgccctgcctcaaccaaaattttataggcctcatgcaaaagagttccagaaagactgagcacctgctatgtgtaatgttctctcttaggcttctatagtagagtacgacccttatggagtttgayacaggggaagagagaattaaaatacagtaaatgtataaattaggatgttctaaggacagacamaaatgaaccgcataggcttaaagaggaaagattccatcccctgagggtggagttctagagggaggaagagacattcgacctgaccttgaagggtgggtgcaacacatatgagcatgaaggggcccatgccaaatgtatagtgcagcaggagcaaaggggctaaggtgggaagttggaagactagcaaatgggccaatttgaagggarcataaagtcaggagatgagaatagtagggtggtgggaaggataggttttgaggccattaaatataagttgaaaaatggggccccactttcataggcccaatagtgcttcaaaagggaaatattggtgggttttgcttttcaacaagaacttaatataactagttgtgttttatagagataagcctggaaggggggattggaggagarcaatggttctctgtacattagaatctcctggagggctggtgtctgagtggcaccaccaaagattctgattcagctgttctggatcagaatctacagctcacacctgtaatcccagcactgttggaggcctaagccagaagattgcttgagcccaggagttagtgacaggcctgggcaacatagcaagatcccacctctacaaaatgaataaataaataaataaataaataaaaaacaaaatttgagttggtaatttataaactatggtgtctacctaccagagatttttcgttataattaaaatgtgatatggaataatgtattgtttggcaagctggcttcagggttcccaggtaaatagataaataaggaagtgcataatgtaagaacagtggctgacagtagcagtggcattttttatttttaaaaacattcctgataattctaatgagcagtcaaggtcgagaactactagaatagagagcagacatggggtaactggttaaggtattgcagtaggtcagagaggataacagggacccaaactctggaaccccagggatgagggagaagtcaaaggtgctaccagagtttgtgccacagctccactgtcccatggttgtagtttcatctactgataaagcagtgcaaagaggaagcgtgtggtggctgagatgggagtgagatttgaggaaagaacgcttatgggtaggaaatggacatgttgaccttaattttcatgttaggtaatgcccattgtgctctacagaacattcatgagttggatgactttgtatatgatctgtcctgctctccatttcaaaggcaagaccaccaaaattcacaagcttattatgttgtcactaatgtgyaagccaccagtttttctgcaagttggaagttttctcaacagtcaaatattcccccttctcactaatcttaaggttttaaagttatagctgcaaatctaaaaaaaaaagaaaaagtaaataaaacttattgacagaatgcctgatagtttatttacaggtttttgtttgtttgttttttgtttttctttgttttttattttgacacaaggtcttgctctgccgcccaagccagagtacagtggtacatcaaagctcactgcaatctcaaacacctaggcacaagcagtcctccctcctcagcctcctgagtagctgggactacagatgcatgctaccatgcccagctagtatttttatttcttgcagagacagggtctcactttgttgcccaggctaatctcaaactcccagcctcaagtgatgctcctgcctcagcctcccaaagtggtaggattatacacatgagccaccaccctcggcctactttacaatttgatgcaccttttctttacgtgactgtgatgcactttaatgggcagtgactttataaaatggtaactttattggatatgtggagccccaaatgggctgaygtgagaatgttggggtaggtggtgggtggctggatttagcaaagaaaaatgtaggctacccagttaactttgaatttcacatggattttttttttttttttagtataagcatgaaatacttataccatacttttagcattaagcgtggaatttgggacataattatactaaaatatcattcattgtttatctcaaattaaaatatcactgggtaccctgtattttatcatatgttcgagtgccttctgtcagaatttggtgaccctttgagtctgttttaaaaaggagcatgtttggccggacacagtggctcacgtctgtaatcccagcactttgggaggctgaggcgggcagatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctcaaaaaaaaaagaaaaaaagcatgttcccacctccccataaggaaaggctcttcagaggaagttgaaggaacagaggctttatgtttgatttttgctttaatctgatgcctactgtttgattattcaatatttagagatggtactttggcaatcaagttatttctctccccaggttgcccacttcaatttttagtataaggatgtcccagagggataaatgccatcaaagttgtctttcttcttctgaactgtaactgggattccacaccctccttttccacccctccctagttgagcaataaaggggaaaataacagtatacaaatattcccaggccagttcctggtgtcaaggtacacagccatggatgaatcatgaggcttgagtgcatcagagacctaagcgtgggcaggaacccccagagtacccatgtgaatgytctgcttgctgcctcgcaccttttatgacaattcccacaagaagctatgtggtctgtttctacttctgaargagcagcctttttcccyttttttttttttttaaaccaccatcctttaaatcatttattatgtaactcttgtgtgctggtcagtcagtgtgtcaaaagtgtaaaaacttctttatttatttttttaatctatcttttaaaaaatattttctttctttttttcttttttcttcaaggcaggttcttgctctgtcacccaggctggagtgcagcagcacaatcatagctcattgtaacccagaacacctgggctcaagcaatcctcccacctcagcctcctaagcagtgaggactataggcatgcaccactacacctggctaattaaaaaaacatggccgggcacggkggctcattactataatcccagcactttgggaggctgaggcgggtggatacctgaggtcgggagttcaagaccagcctgaccaacatggtgaaaccccatctctactaaaaatacaaaattagccaggcacggtggcacatgcctgtaatcccagctactcaggaggctgaggcaggagaatcacttgaacccgggaggcggaggttgcagtgagccattgcactccagcctggcaacagagcgagactctgtctcaaaaaaaaaaaaacaaaaaaatttttttgtagagatgggggtcttgctgtgttgcccaggctgatctcaaacttctagccataagtgatcctaccgcatcaacttcccaaagcactgggattatgggtatgagctactgagccctgccaaatttctttatattaaaccaaaacgtacatttactgatatttggaaagaaagctcttttacttttatgccttcatccagtcttcatagatatcttcccttttacattataactgtaaatactgaggttagagaggttaactagttagttcaacagaataatataaatattgaataatataattaatgaataattagtgctgaacctgtcgcctcagccaggtctcctgattccaaatacagtttgccccagctccccacagtcttctagcttctctgccagtggagcaaattttccctaggtttacaggcctaagcacagattcttagttacttagtgcaagtattgccagagcccaaggggtgaattccaaagggtttttacaaggctatacataaaagataaagccctggcttgtatatcacttgcacataggagataaagccccagcagttgtatgtaaatttcaaaagcagagaagtatggcacaaagaaactcctgatagtaacactgtgttcccactttgcttaggggcatattggcaccgtagcatggtacacccttactgctacctgccatgaggccagataatagctagcagcccctggtctcattctactctggatgggtactgctgtttcctgaatgaaagacactgagattgatttcatgctaatgactgttggttaagagttcatgctttctattcacaatagcaaagacttggaaccaacccaaatgtccgtcaatgatagactggattaagaaaacgtggcacatatacaccatggaatactatgcagccataaaaaaggatgagttcatgtcctttgtagggacatggatgaagctggaaaccrtcattcttagcaaactattggaaggacagaaaaccaaacaccacatgttctcacttataggtgggaattgaacaatgagaacacttggatacaggaaggggaacatcacacaccggggcctcttgtggggtagggggaggggggagggatagcattaggagatatacctaatgtaaatgacgagttaatgggtgcagcagaccaacatggcacatgtatacatatgtaacaaacctgcacgttgtgcacatgtaccctagaacttaaagtataaaaaaaaaaaaaagttcatgctttgtggacaggtagcctgagttcattcatagctctactatttacctgaaaccttggactaattatttcacttttctgtgccccagtgttgtaatctgtaggatggggtactgcctgctccacagtgggactatgagaatgcttaaaataatgccaagcgcacagtcagctcaataaatgtcatctatgtagacaatgaaattcaagcataattccttaaacctttgtgccatacatccctttggcagtctggtaaagccttcattccttctcagcatcatgtttttaaatgagtaaaataaaatatataggattacacaggaaaccaattaaatactgctaccaagctatttaaaaatctatgatatratatgctttttwaattaaacccttaaatggatctagaggtaggtaaatgtctaacagcagatattttgaagttgcaatgaatgtaaatggcactttgagctatctacaactgaaatgcgatagaaaagtatctataatttctattagtgacagtcacaaatactactaatagtattgtggtttgttgcttatactcatcatcaaaggaaatactcaatttgagttaaaggtttaaataaagatgtatttttcccccatccaagttcatggatccctgaattctacccatggattccttggtcactggactccataggggtcacttggggaatgattgtgacaccaatgaaggaagccagcggatactgtttgctgtattatacctaccataggctcgtgatgaggaaataataaaataaataactgtaatgaaaaagaaaagaaaggaaaacaaaaggaayctaaaacagagaaggcaaatagctttccttttgagtgtcaattttaacagactccctgtggttgcgaaacaatgtgtctgaggctggctctgggttagagggagagtgctgttattgattagcaattcctgcatgacagcagagtggcaacagccatgcatctctgacctggcacagtcataagcatgttatagacataaagtgttagggaacaaataggctctagcaaaagtaaagagtgttcctcctctcatatcatcacttatatgtgtttataccatttatgttgtattttttacatgaatacttttagatttattaatctaatccaaaaaggtttgtatagctttctctatattaagagaaatatatgtatttcttaaatacacaaagttcttaaatctgatgccagcgaggattgcttccagccacaagtaacatatatcagattaatagtagttcattcaaagagggatttattttcctcacatgaaaaacagctctgtgggtgacccaatatagagcttgttcattgagccagtgattatatcaaggaactgggttcttcatrtattttcattctttgatctccccctattgactttayagctgtatctttctcaaggatgcagaatggctgccgcagtctcaaacactgcgtgtgtgttcaaatcatgaagaaaggagattgagtgatgccagctagctctcttctcgtgactctcctttgtatctagaacacagtgtctttccccaaaacctgggtcatatgactacacctcaatacagcggagtctgggaaagcaaatatttgctttgcccaccactacaatagaaacgacaagggagaaagaaagggggttgggcatggcgttaattttgtcagccgctagggtctgccacccagaaaacagaagtccactaacaagcagggaactgattgttctgccagggaaaaagtctggcagtttcctactgaagaaatttggaagtcttgatggtccaggaaggataaaggcaaaaccttcattttcttttatcaaaaaggaaagccaagaaaaaaattagttaagtagaagttatgcacaaccctcatgtaactcttccatgttaatagcaggtaggctgcatatgaaaacatgatattatacaagaaaactagttgatgaagattgccctatttagcaccaattacttacgcaaacctaagttgactctgaaacaggaaccccatattaaacttttcaaacacatcagaatatgttactttgaacagattttatttaatccaaagagattatctttgaaaaaggtagatggtaaacatcgttatccctatttttgtatagtcaaataggcatagtagtaagttgtgtaaaattgacatccaaaccaatgcatgatactaaaacttggtgtacaaacagcagttacatcctattgctttgtatctacatctgtttctggagtcatataacatttgtagaatcttggaggtgttttaggctcatccttattttatccataaagaagactgacacctatagagattaactgacctgccaagggtcatggcagtttcactgctgagacaagaacacagatccctttacttctttctgagaaaagtacaaagtagtttaaagcaaaagcttccctgcttccagcacttctggctaagttgcgccgtgggaaaattgttttgtctgattcagttttctcatcttttaaactggaataatgctacctaatttacagggttgtttgaagaattaaatgaatgcatggaggtaaatcacttagaacagcggtaaattatacttttttattatttatttcctttgaccacccacaattatcatcagtgtcatcctcatcatcacaattaagattactaccacattaggctacrtaaactttttttttctctctctctttgttttataatttcaattttattttagattcaaggggtacatgtgcaggttttacatgggtatattgtctgatgctgaggtttggggaacaactgatgccatcacccaggtagtgagtatagtaccctatagtttttcagcccttgtctactcccttcccttccccttctagtagtccccagtgtctaccatcgtcatctttatgtccatgtgcaccattgtttagctcccagttaaagtgagaacatgcagtatttggttttctagcttatttttcctctcttaaatcacttctgtgacacgtaggccatgagatttattgtattttttaatgccttatttaaaaatttgtattatttaatacatttaatgcattattttttattatatttaaatattgatttatttgtactttttgccttattgctatattgtttcaaaaaawttaacattatttgagttacatgatttcaaatacatactgattaacattttaattagaaactttatgtctgatatgaattgccaaaatgtgtagttggtacaacctatgagtcattctgggttatctagaagaaactggtagcctgccccatactccagaagccttccccagtgtctagacctcagaagctgtcaggaatatgcacaggagaaggacacatggcaaatagctatttcgtctcttaaatgtatggtatgtgggaaccactgaaaaatgtaaagtttctacaaggtgctatttttattatttatggctctagagaacagagaaggtgaaaaatgtgagagagaagggaaagccaatagtatgtggccttcaaaacaaaagatcccacagatattgtcccaaactgcttcctggccctctagagtggagagggagggggaagacatcctattagagttcaacattctcttattatttccttcttttaattttctgggtatacaacagcaaatagttttgctgaagtagttacagaactagttggtgttctccaaccttcctattccaatacatactgtcatggatgggtacactaaaatctcagaattcactgctatatcactcatccatgtaaccaaaaaccacrtgtacccccaaaagctattgaaataagataaatacattcttatttaaaaaaatactgtcatagggatgctaccttcttttcttttttgttagtaactatttgtgggatgtctttggtgtgtcaggctctgagcaatgccrttttctcttggcttctttgcagtctctgtgtgaggcttacagtcatttttcacgtttgactcttcagaaggaagacagggctwctggttctacatctggaactcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctttctattttctctttcatctgctttagacttmaactgtgttttatgtattgctgtaagcctctttaaaccctttmtaaaacaaagcagggaatacataaacaaatagttttttgttttttgtttttttttctttgtaacagaaatcgacttaaagcctycagagaagtagaatctgtagaccttccacactgccacctgattaaaggaattggtatgtatatgaaaatgcttgttgggcacattgcattttttggccattaacattaaaacactcattaatggcattttagcatgaaattactscttttcagtggataaatcacattagatcaacaaaaacctctttggtcaacctcttgatctgatgaaccctgtatttattcttctttcctaccctcactgtaaattattcttttttgtgtgtaattctatgtttagcatttgatttcttgcttgttttgtgacttctctgaactatttttgttgcgtctgtattgtttgtcaggtatggccgctgcagtctgtgttctgtgagccttgtggtcagctagtgaaggaagctttatgtaggcagtgacagcatttaccctgctcactactctataactaggatctgatcttayggctaacacgwaactgaccaatatggtttggttgtgtcmccacccgaatctcatcttgaattgtagttcccataatccccacgtgttgtgggagggacccaktgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacagtgagtcaattaaacctctttcctttataaattacccggtctcaggtatgtctttattagcagcctgagaacggactgatgtaccggcacttcacaatatgtattgtaaaaacttgtttttattttatcttctaagctatgactgcagagggggagtctccctcttcccttgactttatgtaggatgtattgtggagtctgagtctttgagtaggggttcctaagagcaagccccaattttgctatagataaggagggatctgtccagattcttctccagcactgagggtctctctggtgtgtttgcagtttttctccaaggtagagtctgtgtcttgctgtcttttaccctttatcatctactaagtacatgtccctagtacataatagactagtagttagattatcaatgaacaataaatattggctttccttttttttaaattttaattttttttttttttttttttgagaggtggcctcactttgtcayccaggccagaatgcagtagcgcaatcttggctcactgcagccctgatatcctgggctcaagcgatcctcccgcctcrtcctcccaggtagctgagactacaggcacatgcccccactcatggctagttttttatttttgtagagacagggtcttgttatgttgtccaggctggtcttgaactcctggcctcaagcaatcctcccagcttggtctcccaaagtgctgggattgcaggcatgaggcactgagcccagccaatattggctttccttagatatggttcatggtatgattagaaacaaaaagaattagcagtcamaacacctagtttctagttctattctgccacaatgtaaccttaggcaaagttggtttttgtatttgtcacctataatgatgagtttgtgattagactaatggtttttagactttaaaaagcctgggaccatttatttataatcttactctgagagccacagtgtggaaataactagactgtcattgagtcacttctagtcctttacaacaacatccttctctagaggtaggagagacaatttaatattttgttttactctttagaaattaaaactcgggttacatggaaatgtkctcttctctgaataggtaacattgttaaacaagttttgagtgtccttccatctttttctttttatgaatactcctgtacataatttttaaaaacataagtgaggtcaaattatgcataatatttcaaaactagctttttgtacttaatactaggttttggaaacttatgtttgtacataatgttaccttttcttcacaactgcacagtattttttgtgcaaagttcatataaacagtgtatgtgcaaacaatatagaaagatataaaatggaaagtaaataaaaataaaaatctctcatcaaactcttcatcacccccaacagaaataaccccaaagataaagctyccttttttatctttcctgatagtttcagtgcatttgcaaacaaatatattgactctttttttcacaaatagaattttagtgtaaatatttcacaaccttcttcattcctaaaacagtgtgagcagctttccacatcagcatatatagttactttgttctttttaatattttcacattccatgatttatttaaccattccccttttaatgtacatttgggttgttacagttttttgcaactatgaacaaatcagtgaacatcattgctgttgagtttgtgtgtctgtagaatatgtccttaacaatgggattgttgttcccttagaatatgtgtttagagttttgacagtcattgctaagttgctctcaatttggcaacagtaataaactcagtacctcatagttgtaaccacattcactccagacagagttctcagcactcttttagtaaaaataaaccatcagttgacagtgccaccttcagagtttctctacaaataccttgcttgcctccctttctttttttcttcttttaaatcagcttcctcaggttgatctgcctctcattccttaggcatctgtttcctatgtgttctttctmctttttttcattgatacttttgtatttccccagttctacctcccctcccctagactggttggctgtcctggaatttcccttccttctttcaattgcccaaacactwagtgggaggaggcaaactcatatcaaatagcagattgactacatctgtgctggatcatgcagacagttcaagagtcccaagtaacttagcagcttcatcttgccttccagctgcaatcaagaagagccctctcagaactggtcactcagcaaaagccagatggcattagtaaaagatgttgggcaagggtgggagtttgggccagtgatctcttaggttacttttgctgctgagttaataattgtcacattattaaacagcccttggccctgggaagcccaccttctgtgaatacaagtctcagagtagacaatagggcmcaaccagccatgttacatgacagactgccaagtgcattcctcttacaactcactgggatggagcgctcctcagagaaaaacaagcccagcaacatttgtattctgaacaggcatctgtctatgtttgtgacctttatgttgtgatgtgtgtgagctgctgtctggaattggaaagaatgaggaaatatgtcacctatggcccctcttgtgaagtgttaaatgcctctgaggcacttcaaaaggcaacagagcggagaggatgagtgattagaagcacatttgggatacatttttagatctaattagaattgtccttttttttttcttttttgcttttgccctgtggttagcacacaccatatgaacgtttgtcgaatgctatgttagtgatgcataatggttaataataacttttggttatatatctttaacaacagttgcttattcacaggtctttgataagaagaaataacaatgtgctggacacacatttctatacaggcaaaagtgactttttatgatagagagggctgtttcttattttctgttttgaaaacagtagtagctatgcacttgaggccaactaatccctctaagaggtgaaccttccttcccccttgcccttgattcccatcaacacacacatacatatgcacacactaccgtgcttcagtcaccatcactggaagtgaactatgtgcaacttttgggtgctttatatatatcatatcatattgtgtctgctttaataaatcatagttattgactacatatcatacaggatgtgtgccttctgtgggtcagaaartaagttcactatttagtccttttcaaaaattccttcccgatctatcttatagacagaaactaagcttttatacacccaagatttggcagattaacatctgcatattaaaatgtcaagagctagttaactttatttgaggcttaaaagttaaaaaatctgattttctaaatgtctggccttcaaaatttgagtggactgtctttctcaagataactaacaattttatgcacttggcagtcaagacctttacaataactgctgcttgggagattgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttttcccagggtgactaatgtatatacttgatgagtgaaccagaaaagtaggaaataatatgttacatatgggatgctctattgggtatagtaaaggatgcgttgctgttataaaattatagtcacttagaaaagagatgtttatttttatttttctctcatcagtcttaaggtaagtgaatggcctagggtagttaggtgactgtgttccatatggtcattcaggggcaaatgctgatgaagcaacacagctgtcttcatctaagactagaactcygcttgttgccatttcccagcaggaaggggttgaaagaaaatttatgtagatttttttttctacccagtagttgcatatatattgtattctcacatcctattgacccaaacttagacatatggccacatctgtcagccagaaagggtgggcaatgttatctatagctgtgttgctacgtgcctattgctaaaaaggctaaaaasgaagaaggggaacatggatgctggtgaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagactwaaagaaataagaggcacatcaatcaattgaaatgtgtgggaccttacctggactctgaattaaacaaactgtaattttttaaagctacaccttttaaacatgattggctatttgaacactaactagatatttgatgatattgaggaattattgtgaatttttagtgtagtaatgatattgtggtttgtataaatatatttagggataatatgatgcctcagatttgctttaaaataacacaggatgaggataagtggtaggactgcaagggaaacaagactggccatgagctgataactgttgaaggtgggtactgggtatataagggctcaccacaccattctcttgatttgtgtctatttcccataataaaaagtttaaagagagagaaccgatgaaggggagggagagagtcaagcacacaataagagtgacaaacagtgccaaatcagcccacagtattaagttttcacatatttacataaatatcacctggaatgcaatattgaaattaatgtatatcactagaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatrgaattgaccacaattgaatttacaagtgaagtggctttacagaggaatcaggggatgtttytgagagaggaaattcattaaattctaacttgaatattttctgtttgcctttaagtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgacataatcacaccgaagaggggatacacgatgataaaaccttcctgcagtagtggctatagaaatgatgacggggagaagatctggaaaatattccaaagaaggctacagatagatacattttttccattggaattaggcaatggagttaaacagaagttacaatatggttgaaataaatgtatttttttwaaaaaagatttctctttccttaattattaaaaaatatacaattttgtagaaaattttaaacaaagtataaagaaaaaaataaaaatcattcataatcctatcaaagaagcattgttaattttttctatatatcttctttttccacgtgtatacttggaaattaaattttctaaaataattttcaggaaaaacaaattttaattaattgagcttctactaaataggactgaaaagcaaaacctggactagaattctctctcggtgtgtgtgtgtgtgtgtgtgtgtgtgtgtgtgtgtctgtgtgtacatrtgtatgtgctgtgtatacatgtgtatgtggtgtagcgttcccctgattcttaacttattaccagtggacaaccaccgtggaactagagtctagtcattcttaacctttttgggggaatcacagtctcttttttgaatctgatgaaaatcaaggaccgtttttacagaaacgttctcatctgtgcatacatgagacattttgcattgcatagaatttccgagggttcacagatactttgaagcccaaaagtgatccacagaccccagattgagaactcctccrctatgccatgcttaagcttatttctgtgtatcttctttctgaggagcaggcagatgggtcatctttacaatgtgaagttcttggcatttttattttgttttgtttttctgcactacgatggagcaagcaacactggaggcaactggctaaatgcaaactcatgaagcaagaccaaaatggctggatagatagatgctgtttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtctaattatttgctgtgctgtgtggagtgtactgcagacagtcaataaacaatcaatagtaattgtagcctgcctcagagacaggagttagaaacttcaactggcttaggtgcatggtatttttcattaattttcttctgctagtttttttctctaatttaaagcctaaatttaaagattaaatagaaaagctttctttgcttatgagcacaagtaggcactgtttttaaaagaaggaatatataatcccaggtgttttacctctgttaatgagaaagatgtctgtttgcttcagattgaatgagcaaagaagaggacaaggatatttgcatggttaaatgcctatgagcccttccttcagaaagtaatattcccctgatgtcaattacttttatacggacatctggatgtttatcatgagagtgtacagatgtcaactttttcagtattatagctggaaatgtggtgataacttgactttgatttgagtaaacataaaatatctaacatttaaagtcagaagttcacttcaggaaggggtttaaactgacatttattaaaaagaatggttccttggaaaaaacatcagaaccatccctaaagatacagtcactctgataaagtaaacagagtcccagttatgctctgtgtaacaaataacagaacttgaacatgacatttatctgttccttaaacttacagaagctggctctgaagatattgacatacttcccaatggtctggctttttttagtgtggtgagtgtcttcttccttccccaaattcagcagaggagatacaagggtatttgatgagggctgcagaacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttttgttttgttttttcttttttaattttttttattttttgagacgsagtcttgttctggttgccccggctggagtgcagtggcatgatctcagcttactgcaacctccgcctcccgggttcaagcaattcttttgcctcagcctcccgagtagctgggattacaggcgcccgccaccatgcccggctaatttttgtatttttagtagagatggggtttcgccgtgttggccaggctggtctcaaacacctgacctcaggtgatcgcctgcctcagcctcccaaagtgctggcattacgggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattatacyaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgtccattctaattggaaatccagataaggggacagatgaggaggttctgaccacctacctccctggcttgggcagacataggagttcttggcatcttcataggtccagtttttctggaggaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatrtatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataamtctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccrtgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccacaaaactacagcaaacatcattcttgatggtgaagcattggctgcatttgcattaatgctcagaacaggaagaaaatacccaacaccacaaccatcagtaatctactagagttcttagtaattcagtaaaacgagaaaaagaaatgtgagatagaaaagaaaaagacaaaactgtcattagagaagcagggactggctcaattgcccaggctgatgtgcagtagtgcaatcatagctcactgcagcctgaactcctaaactcctgygctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaargaagaaaaaccaagggcacgggaattaagaatcagtcgtgggtttgatttggcctcattcaatccacatggcatcagcactttcatagacaacggtaagagccaatgggctaccaacatttagtaacgtgtgatggttcacaaatgactgtgaaaaatagatttggatcatatttmtaggaagagaagaacaattaactcatgagtgatttctgtattcttcattacaaagaacttgttcatttgcctcttcagctggcagtaagttatgctacattttgaaattcctaacaggtaacacctgamagaatgtttagatttcataatcttttcatatacctacgatcatcacatttaaaaaagaactgtatttttgaattaaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtcccrtagttatgtcttgtaaattaactctgttctttcaattctttagatgacacagtttatctctttgttgtaaaccacccagaattcaagaatacagtggaaatttttaaatttgaagaagsagaaaattctctgttgcatctgaaaacagtcaaacatgagcttcttccaaggtacttcctcattttgttccttctctaatttatccccagcatttgcaaacaatccctatggtgggttgtcctgtcatcttttataagygctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgagggtagaaggcaaaccctaacattttttcctgctgtcaccctccatcttagatgactcatcacccagatgagtgtcttgccaaggaagaatggcctgttttttattgggtttgtatgctttgcatgggactttataccaatcgctttcatagggttagtgatggttgcatgctagtaatcccacagaattagagccactcaagttgagagtgagtcattacacttcaagaacataaagctggttgaaaatgtggctaaragagaatcatgtgtacccccacccccagttcagtgtgtattagcctactgcttcttttagtttaaacttgatgaatatttttaatttctaatgaaatttcatttctaatgaaattaaaaatattgcctatctagggcctatctatgcctatctagggcataagcatgtaacttccaatcattccttccaaaaatgcacttgataaaaaaaaataggagcataaataccatccaagcattatggtgctctttcagaaaaatgagacctaccttccctgtagctctatatttttcatttagcaaagaataaagcagctctttcagaaatttttgcatagagtaattggaatttaaatttaataacaccctcacctaactggtcttaaaatgaaattgtttttagcatataaatctctcacctgaagcattgtactatggcaattttatcatccatctctctgcaagtgtttattgagtgcctgttcattctcggcatgtcagctttgtgaagcaggtagaaattgaacagtcaaccttagtttgactaataactaagccagggaaattagaaaaatccaggaactgagtaaatggaagctaggtaaatgttactgactgcctaaccagctcaccagccaatcaggctctctccagctctgtactgtggacagctctgtccttacgtataattgttaaaccctacatttcttgctgtcaaaaaacatgccctgatggcactaagttctttcttctcttatggtaatcctgccataattgctaaatgacctgtgttcagattacctggtaccatacaaaattgttctctggcaacaatattatagtatattgtatatgactatagtygtgatttttagctcrtcttttcctcttaccaaaaatttaaagcacatgttgcataaatcttaygagtacttaatatttaatatggagaccaacaggccttttrtttcctctcacatgctatttttctttttcagtgtgaatgacatcacagctsttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttattggctatayattattccattataaggatgatcttaaactaatttaaccaattctctattgatggatatgtgtataggggtggggagttctacataaaaaatattttatacttcttatttaccatggaattttaaacaagtattttttttaaagaaaaagtccctaggagagtgttttttttttgttttgttttttggagatggagtctcactccgtcgcccaggctggagtgcaatggcatgatctcagctcacctcaacctccgcctcctgggttcaagtgattctcctgcctcagcctcccaagtagctgggattataggcatgcgccaccatgcttggctaattttgtatttttagtagagatgaggtttctccatgttggtcaggctagtcttgaacctccaacctcaggtgatccgcccacctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcaracagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctmcctgtgcctccttcctctacccccaaactcctttccctttgaktgagacctgcctartttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagatttcagtggaatccaattgcttatcaaatcaaggcagggtaaagggttggactttgtttaacaggccacctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtgagcctttctgtgtcctyggaagttagctatttctagacctgaactatttctcatgcttattaggtgtttaatgtgtacaaaccagtgagatttgttccaacacactataaactttcaaggagagaggctgtgtcttcttcatgtttatatctgctrcaacactgagttcatggcttttcacacataattgctcaacagagcaggtgccatggaaagtcaattcaatgagtaaaattacctcaaaatagtcygttaattcactcacctttgawgtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagggcccatgattgattaacttcttggcaggttattaagacttattctttcacactgtattaatgaagctttatattggcatggagctctaaccactgtgtcctttctgcaaaggtatatctatgttgctgacatattggctcatgaaattcatgttttggaaaaacacactaatatgaatttaactcagttgaaggtaaaatatttatttttacatatagacagtaatctattatgctttgcaatgacatagtttttcyataagagtaccacacgtagaacaaaatatggatgccagtgtagctattctgggtttttaaatactccctacaactagagaaagctcctgtttccagcgatcwcaagaactgaccatgattacatgcagcagcaggttgagagtgatattcatcagatttagggcccattccatgaagtattgatggcagtggaagaattccaataagaattttcacaattgaaaatactaatagatgaattctcaaatgaaggtttatgcacagtgtcagttctttcaataatamatgaaggtagaaattgggttccacaccattattattttcttcctactcaacaacacatattttaggttgattaagaatttcctatcttgctttgattgagttccttgagctaactgatcattgtgcatcttttaaaggaaaaggagttcagtttttaagatagatttttacagagaccgattatcaccctaactttcttaatttcagggaagaagaaaagtggctccaaaccagtttttaatacattccttttaagcaatattggtgttagaaggtggaagcagggcgatgtgtaatttcctcacatgcatagaggcaggaaggttacctctaaattatttaatcaagtttctcatgtcatttagatwttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggtttttatattttcagttttttaaacttaattattcaagtccttttgaactaataatacaataaattgtcacagggatgatttgtttagttattttaaagcaataatataataagcttatgtcgtggttttgtaattgcgttaagccaataattggcagaatgttacattgttcaaatactttaagaaaggtaatcttttgatgtattaaattatggtggaaactagtcaaaaggcatttttataaagacatgtgcccttcttgggtggtatactggcaatttttaaaatatctgatttattgtcagctcaccacatgatgtgatatttgttcatgttgaagtagtgtgaaagtaggcacattagtatgaaagtatttctattaaagctgaattgctataataacactaaatcctgtgttggcatggaataactagatggttttaagaaagtactttctttgaagattggagaaagtactttaatttaaacattaaaaagattggtaactgctattttcaacagcatgtccccttaatcagtgtgtcattgtggaaaacagggcttattgatgattgagtgacatgcatgtacggtggtcttatattcawactttgtatcccctgaataggttctccgcatccagaacattctatstgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgwtaacgtattttgatgttttgtacttacatctttgtttaccattaaaaagttggagttatattaaagactaactaaaatcccagttttgtctgtgtttaattctgaaggcatatggctaggagaaatgggaaagcagctgcttccttatggagtttggataggcaagcatggccatattaatttctcttgtggaaagctgaaagtgaatgsactcttaatttgaaacaacaacaacaaaaatcaatgaaatattgmaactcaaattcccagttcctaaggaggtttccatcagctctcttccttaatgggagtccactttagagacaaagaggaaataagggttgggacaggaaggtcttgccacctcctcattgaacagaactgtgaactaaagccaggagaatgaagtcagtcrtccgtgaccacatggttaagcagcagcaatgctaggawcagggccgcgtgcccagctcacagagggagagtttttctgctcactgtacctcctataaaatcatcataagccctagagagagactttcatgtgtttctttccattgtaatttatcaaaccactttacttcacttctcatactttttccctatcatcatcatgaaaatatttgtcagttaattacaatatgccaaacaatgcaatgaaagtattacattcgttatcttatttaatcctaattgcagcctggagtaagtattgatattatatcactgttaacatttcacagatattcagtctatttctgatgccagagcctgtaccgctaaccactacatgatgctactgccatagaacgaactagtattttattactgtttttcctgatgtatacagtttcttcatgttttgtagatatgtttgagttctgcttttagatgaatcatttaatggattttaaatttaaatttcagtagtattcttaaatttggcctgtatccatttggcctgtgttgttatttatatatttaagtagtttgctacatattgtattggatttatttcatgctaaaataattattttcttttttgtttacattgtccatgggaaaatgctaagtcacagatgaatacagcaagattaaatattgcagacctagggatccaaatgaagaactagatgttttagattttatgagattatatcagactatctaaaaagctacatttataaaaagtactggaatacagtaggcataaaacaaacttggtttctattgcatttattacaaattttagaacaaaaccatgtcctttgcagcaacatggatgcagctagaggtcatcctaagcaaattaatgcaggaacagaaaaccaaatattgcatgtcctcacttataagtgggagctaaacattgaatacacatagacaaaaatgggaacaacagacactggggaccactagacagaagggagaatgaggctatgggctgaaaaactaactgttgggtactatgctcatcacttgggtgacaggaccatccatatcccaaacctcagcatcatgcagtatacccaggtaacaactctacacctgtactctttcactaccccctcaaaaaacactggggagtacaatttgctggatcatatggtagaagtatgtttaattttgaaggaaactgccaaattattccaagtggctatactgctttgcatttgcaccaagcagtgaatgagagctcctattactccacatcctggccagcatttggtggtgtcagtattttggattatactattatgaagtggtatctcattttgatttccaattacctgatgacataaaatgttgaacwttatgcttgtttgctatctgtatgtcttctctgataaggtgcctgtttataccattggcccattttaaaaatcttccttttgttgttgttttgttttcttattaagttttaagagtgctttgaatatttggaataacaatcttttgttaggtatgtctcttgcaaatattttctcccagtctgttgcttgtcttctcattctcttgacagtgtgttctgcagaggatatttatttttaaaaacaaaatcagggcacctctataagataatatagccacttcaaatgatactacagaatattagcatagacatgtactcacagtgtattttgaataaagcatgcaagtattttaaaaaaatttatttggacaaaagtatatgtaagttaataagcacatgtatggccagccacggtggctcactcctgtaatcccagcactttgggaggttgaggtgggcggatcacctgaggtcgggagtttgagaccagcttgaccaacatggagaaaccccgtctctactaaaaatacaaaaattagccgggcgtggtggtgcatgcctgtaatcccagctactcgggaggctgaggtaggagaatcctttgaacccggaaggcagaggtaggttgcggtgagccaaggtaacaccactgcactccagcatgggcaacaagagcaaaactctgtctcaaacaacaacaacaacaacagcaaaaaaaaaaaaaaaaaaaaaaaaagcacatatattatttatcttagaaataaaaaaaatgaataatctctgatttttggcttctctggaccatgaggaattctatcaaactcagtatattgtgcacttatttatggkgtcttctctctgatcttatactgagctgaacaattgaaaacaactgaaactgtaattgggatatgacaccatgaggtgaatataggtcttacaggtgtgtatgtgttaattctttttactccaagattccgtttagtgacaataattgtttttttacttttacaaaacctcagctcttttataacaaatgtgaacatgaatacttaatacaaggagtaagaaagattaaatataagctataatacagtatttttttcatgttgcatatggattaatccttaattgcaactcatataaagctgattcttttctctggactttgatttgctcagtttgagtcctatcttggagtcacagccaacctaggctagtgaatatctactctactcagcaaagcaatgaaaaagtaacagcttaaaagtaacccaccgccacaccagccacttctacctttctgtggctacttgtagttttcattactcacactgttttccagggaaggatttctgggtgtgagagaaggagctgggtgggagaatcccagtagcattctcttttagctttctgcccctgcttttcagcacttttcttctactgtgttttaattttcattctctttttatgagtttaagtacactttgagatatttaaggagatctgtatttatttttctgtgaactttttttttccttcaaggatgctggcctttttctatgaatttctagttcttcatgtgtaaaggagggaattatttttccagttcataactaaatcatccattatgcaattcttgacagggattgaaaacatcaggaaatgatgttttccattagaagagaaagcagtacagatattttcaaacttttaaaatggaacctggttgtcccatcataggcagtattgagtgcagaagacattactcagacctttcttaagaaagggctaatrtaaaaaatacattkattacatgaattgattcaaggcctgaaaatgatgattaggataaacatgacttttgtcactccactttgaagaaaactctccagatttctcctacaatataaaatggaaaccacagctttaaatggactctctgaggctgggaacagtggctgacacttgtaatcccagcattttgggaggctgaggcaggaggatcacttcagcccaggagttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgcactcaagcctggccagcagagtgagaccatttctctaaaaattgtttaaaaatgaattccctgtttttctattcatattgcttctgtttcttggtccccatatccataaatacagccctctttagcagattctccaagcctagacacctttcatttctccctctccctcaccacccctttgctcatatccaaacaattgccagtccctccacctaaacatttctcaaatccatacaattctaagaactttgagaaacaatctcctcaccttctccaatcaccctcacatatctcacccagaaaggcatctaactatctcctagcctccaggaagggtaagtgctccacctgctccataatccactctcatcattgtgtagcaatgtttctaaaacacctgccaaaacatgttacttccagtggcttcccaatgccccttagaatataattcargtttcttaacttggcctacaatctgccttcctctccagattcaattctcaccatcttcttcccaawtctttaagctcagtgattctcaaagcatggtccctgggccagcagcatcagcatcacctgcaaacttgttagagatgcaaattctcaagccccaccccaaatctaacaaatctcaaactctgggtctaggactcagcaatctctcttttaaggagccctccaggtgattcttaggcctgctgaagtttgagaaccactgctgtatccatactggactatttctgttccaattcccctacttgcggataccccgacctctttctgtgaacctcaccaccctttctccacttaattaactccttctccttgtcatacaatctgacaagttcatgtaatatgttgaatctaccttgagatgtgttccaaactagagtcgctgaggggctaccagatattgatgaaaaatcccctgaagacagttaaagtggaagataaatctggaaagaaccttcctggcaaagtgtggcccctcaaggatccccccattcacttggtgcttacatagtgaaatgtgagcctgctggaaccctggtgctcatcctgctaaatacactcagcgcagatgattcctagcacaccacaggttgcacctgaagtcctgagtgggggaaccttccccatggtgagttgcaggaagtcaccaaacaaggtatcagactttcactacctgacttcattattaagtgcatcttcagaatgaaattgagaattttatttaaattcagatatacctaaatatttaatacttaaataagtataaatttaaaataataaattttctaaataatagaagtcatttcttaaaataatacaaatatctggtcctctagcatttctctcttctgagcagcactagactcattaatgccatgtagtcgtacccaggttttaaacagtggtttctatggcttaggacaatgtttcctaatgttctaaaatccatatcctctttttaaaaaacagctttattgcaatataatcataatctcttttgatttgttgctctttttctctatcgccacctctttttcttggcaagattcactgatagaaacaatctttttaaattaaaaatgtagcgattgtaaacatgatcaagatataaagtttgaaaattttaaacattacagagggtcgtacagtaaaagcaaagtctccttccatactcactgacctccccactctccacgaccccaatcttctgctctcaaagtaactactcttcagtttatgtctagattgtttatatatayayayayacacacacacacacacacacacatatgtggataatatgtaattcccctaattttataccttagaattataccacatgtatattctgcatcccccttaatggcattttgattatcaatggtgtgggactccctagatctatatatagtattgtgttacttactgtttaaacgtatagcattgaatttggtctacattagctctttgaaagccccactatacatataaggaaagaagggtccagaggtggtgataagtgatttcaaaagattaaagggccaactacaaatggaattggatcttgaatttaggccttttgaatttatctgtcctgctctttcaaagtcaacaaaccccttttacaatactgatgtacctgtggcctcttgaccaagtcaatttggcctattgccaagagcag

SEQ ID NO: 13206 - DNA, 22242 bp, Homo sapiens
  misc_feature (1)...(22242): n = A,T,C or G, or insertion/deletion polymorphism (see Tables 1-2)
gctaggttcacagatggggaaaaatgatattatattacatacaaactttcagcataataatgacaacaatgacatcaatactagccagcatttactgagcttttactgtgcttcaaaaacactgctaagtcttttatacacttaatcttctcatttaatcctcaccacaaccctaaggaaaagtactatttccatttttcggataaggaagttgaatttcataaaggttaaatattcagtcactgtaacacagaaggaatctaaccggggctgaataactctcctttaacrtaattacaagttaagtcagtctgctcagatcaccaaagcagaaaatcacactacagcaagaagaaatcaaaggtatgaaaaggaaagctatcagaatcaaagcatctggaacaatgacctaaatataatagctaaaaccataaaactcttaggagaaaatgtagaaataaatcttcgtgaccttggatttggcagttgattcttagatgtgacaccaaacgcatgagcaaccaaggaaaaaaatagataaattggacttcatcaaaattagaaacctttgtgcctcaaaagacattatcaagaaagtgaaagacaacccacagaaatttgcaaaatgtttgcaaatcacatatctgataaaggtttgatatccagaatatataaggaactcctacaactcaaaaaaaagacaaataacccaattaaaactataagcaaatgacttgaatagacctttctccaaggatatacaatgcacaacaaccatgtgaaaagatgtgcagcattatccattagtcactagggaaatacaaatgaaaacaaccatgagataccacttcgtgcctacttagatggccatgatcattttaaaaattaaaaataagataaaaaataacaaatgttattttgaatacagaggatacagagaaattgaaatcctagtacattgctggtgggaatgcaaaagggtatagccactatagaaaccagtttagyggctcctcaaaaagttaaacctagaattaccatatgacccagcaattctactcccaggtgtatacgcaaagtaactgaaaacaaaaattcaaacaggtatttgtacaccaatgatcattgcacaattgtgcagagcagccaaaagctgaaaactacctaagtgcccatggatagatgaatgaataaacaaaatatgctatatccatacaatggaatattatgtagccattaaaaaagagtgaaattctgataaatgctactacaacatgagtaaatcttgaaaacattgtgctaagtgaaataatccatacacaaaaggacaactattgtatgttgacatttataggatgtacctggaatagtcagattgatagagacagagcagagtagagattactagtctggagggagaggggagaagagagctattcgttaatggatacagagtttctctttgggatggcaaaatagctctcgaaatggatattggtgataattatataacgttrtaaatgtacttaatgaaactcaattgtacacttaaaatggttaaagtggtaaattttatatgatgtatattttaccagttaagaaaacatagtttccttccttaaaaataagtcactcataacctatggaccagatcactctcattagctccagacccaatttccagctgaaaccttgaacccgatgtccaggatgtccatgatgtctttactttcccacgaccacatctgtttccctcacaaaatcaactcctagtttcttttcctataagccatgtttccatattaacagcwtgaccacccaccaagtctattaggctcagatcatccttgattttcttctcattcctgcagccaatcatctccccagttttggttttgttttgttttgtttttatcaatcctaccttctacatacgtcttggatttccttcctctttttcatcactatggtcacaatcttagtttagggactcatcttccccctgtctcacctggattattgtcataactttttgcttggtctatctgcctctccagtatccctctagagggcatcatctcatcttccacaatctgtctttacaaccaccagtagcattttcttacagcatttcaaatctcatcatgctgctttcttcctttaaaacattccctgatgcccttgggataaagtccaaactccctggcacacgaggctcgctctcaacaacttgacccccacctgcttttccaaccactcaccatcccggaccacagccacattgactgctcgctctactgtatccatgctcttttcccatgtcttcttcctggaatgcccttttccaagggaactcctatttaccctccaaaatccagccaaaatgccacctcttgtatggattactcctcagttcccacaagaaggattaactgttcccttctctttggtagctttgcatattataagcgagtgtcattttgttttaaaagtatttacctcccgatattgccaccctagagcacgagcttctaaaggctggaactgggacttgattccactgggtctttttkcctaattacaatttagatgaacaagagatttctttctccttattcaagagtgaatattgaaggaagtcactaaaattaatttaaagtgtttgtaatttctaatgctctttgaattgctaaaagtaaacagaaatgtaaaatacaaaatctagaaaataccttttttaagactttatttttttaaagcagttttaagttcacagcaaaattgaaaggaaagtacggagatgtcccatatacctcctgcccccacacatgcatagcctcccccattatcaacatccctcaccagagaggtacatttgtttctgtgtgtgtgtgtattttttttgttttgttttgtttttttgagacagagtctcactgtattgcccaggctagagtgcagtggcgtgatctcggctcactccaatctccrcctcctgggttcaggtgattctcctgcctcagcctcctgagcagctgggattacacgcacctgccacaacacctggatgatttttgtacttttagtagagacagggtttcaccatgttggccagactggcctcaaactcctgacctcaggtgatccgcctgccccggcctcccaaagtgcagggattacaggcgtgagccaccgtgcccagcctatatttgttacaattgatgaacytacactgacacatcataatcacccaaagtccattgcatttgtgttcactcttgatgttgtacattctatgtgtttggacaaatgcaaaatgacatgaatccaccattacagtattgtacagagtagatgcactgccccagaaattctctgtgctttgcctattcatcctgcctatcccacgtccagcccacacaactactgatatttttacctatttttgccttttccagaatgttacatagttcgaatcatacactaagtagccccgcagattgcttctttcacttaataacatgcatttaagattcttccatgtttattcatggtttcacagctcatttctttttagcactgaataatatttcattgcctggatgtcccgcagtacatgtattcattcacctactgaacgacatcttggttgtttccaagtttgggcaattatggataaagctactataaacatctatatgtatgtttttgtgtaaacatttatttttatctcctttaggtaaacaccaaggagcaccattgctgaatcatattgtaaaagtatgtttcattttgaaagaaaccatcaaactgtcttccaaggtggctgtaccatttttcatttccactaaaacatcctgcaattgccactgtcagcgttytggattttggcctttctaattggtawgtagtggtatctcattactgttttgatttgcatttccccaatgacatatgatgtgaagaatattttcatatgcttattcactatctgtatatcttttttggtaagatgactgttaaggtttttggcccatctttaaaatcagattgtttgtgtttttattgttgagttttaaaagatacttgtatattttggataacagtcctttattggatatgkctttttttttttttttttttttttgagagagagagagagtctccctctgtcacccaggctggagtgcagtggagtgatctcagctcactgcaacctctgcctctgaggttcaagcagttctcgtgcctcagcctcctgagtagctaggactacaggcacgcatcaccatgtttggctaattgttgtatttttattaraaacagggttttgccatgtttcccaggcttgtctcaaactcctgacctcaggcaatccactggcctcagctttccaaagtcctaggattacaggcgtgagccaccgcgcctggccatggatgtgtctttgcattcattttcacccaatttgtggcttgtgtgctcattcacttgaggaaatgccttttgattttaattcaatgcaaatattaccaaaaacgtgatataattccatttttagcttattcaagtaaagttcataaatattcattattctacaaatatttatggtgcaccttatcacatgtcaaactctgactaaggataccaattactctagttaaactgtgaccgtacagaatcaagacatctctgtaaagagagcaaatttaattaactgatctgaaaattttacctttgctggctcacagtgctcaattaccatgtaattgaagtgatatgtgattaattaaattttttagctccagcatatttggagtgtttcccatgatgtattagagtcaaaagccatggtgttctcccaagtaatgtataatataataaaagagacagacctattacaaaatgaataggcagtgcagtgggatagaaaaagcactgagctactatctgtgtgagctgggagaagtataataagttaaattatcatcttggcctcactttcatttttggtaagaatggagtcattgggctanaatctgtaggtaatggattcttactgctatacgtagaataaccattttgtgtactaaggaccaatgcagccctacctgtagctgggcagcagccagagtcagagtgattggaagaaaaaaattggatctccaagttgaaggtctagccttggaagaatctgttactataaaatgagaagcagaataagtaagccagatgaagagttaaacccgtgcttgtagatttttgttggcttggtatttttttgtgtttaattcaagaagaattagaggcagtgttccccattaagaaaagacataaactgattaaaaggagacccaaagaagggaattatcactgctctgctaagggacgtggaaggtgaggggacacagcacagttgtatatagagtggccactaatccagccacacagcagcatttccatctgcctcctgccatctttcccctgtatggagaaccacaggattttggtgatgttctatttcttgactttggtgacggttacagtatttgcttaattattatttcattatttacatgttttgtgcacttttccaaaccttttaattgttaagaatatatggtaccatgtatttaagaatacatggtaccatataataagaatatatatttaagaatatatattattctttaagaatatatggtaccataatgtcctgaatgatacctatgagagcagtcatttgactttggcaaaaaaatgaggtttctcatggagtcaatttatgcagcagacagaaaaaaaaatcctttgaaagacraatacattgtgtgcttcctgccaataaygatgtaatacttcctcgttttagttaatgaaaaataacacatactttcaaagttctgtagactctaaaaagaaagaaaacactcaaatgagtcacctatttccacattcgaggctgagaagctatataaatttctgcagtcactagcagaaaacaccaaatcaaccataggtccaagaacaattgtctctggacggcagctatgcgactcaccgtgctgtgkgctgtgtgcctgctgcctggcagcctggccctgccgctgcctcaggaggcgggaggcatgagtgagctacagtgggaacaggctcaggtatgtcacagcccacttacttagggttccattcttttgccatctgcattaagaaatgtgtttttcaattatttcccttcccatgttagcattgcagtggaattttctttggggtggttcttcggattataaaagcaatatatgttttcatcaagtagccattaaaagcaggtttcagaatctgctcaaatcgggcttgagttccaaccctccactcactatgtagatagactcaggaagktcatcaaacttctctaagcttcaggtttccaatttggaagttggagataagaatggtatcaaccaaatgagggtgttgtgaagcattcaacacaatacctgaaacattgtttaaattaagttcttatttttatttattataacttgagattctttttctatagtatacagaatattgcctcttaagatacaacctgtaaatatactgtttgtgtatttacaatactgtttgtaatggagatatctgaagtcagaaaacatgggtagaaattacaactctccaacaagtcaatgacaatagacaaggcattaacawctgactttgttttctcatgtgtccagtagaaaaaataatattatgtgttttatacctcatggggtattctagtaagtaaatgaggtgataacaaaaccaactagcatgtatgtaacaattgtagattataaagtacttatataracattgtgtcatttaatccttagttctataaaaagaggaaaccaaagttaaactgattagtgtacttattagtggtagagatagaaatcaaggacaagtgcttctggttcaaaaatcatgttccttgcaatatgcttcttaataagcagtctaataaatataagcagtctactaattattatttggttaactaatgggatgattacttataactattatttgtaaatttaggccttaagcataagaaaagtcaatttttaattcacattaacttagacttttaaaaakttccagttataataagttagattgaaccacataaagttactagtatttaacttttaaaatctccaaaacagtagttttatatggttccacctaatgaattctccagaaagagtactctgcgtttagtttctttacttagagtgaaggttggcagaaacttagtcttcacttggagggatgttagctaggtttaacaaaaaaacaggaaaagtcatctcaacaaagcagagagatttcttccagagggtgtcttggtaaagtctgtagctctagaagggattaaatgggttatttgtttttaaataaaggatcagttatcaattgtcatggatgaacaataagtatttgttgtatttaatgagacaattgttggtaacaggaaaaaaagacacaatattaataagatttcttacataaattgcatattcctgggcggtcctaagacaggtaaccattaccatctactccaaataaactgcaaattagtgagccaatgtttaaatcattttaacaacaatattatcaggcatcatataaccctacacatgtttctaatgtatagaagtcagaacacttgagttcaaatactggttccttcagttactcacaaggtgatcttgtgcaatttatttcacttctctgagctgtgtttcttcatgtataaaatagggataacaatgccatacttgtttcatagagtggttatgaggtttacataaaataaatatgtaagtgcctggctctartaagtgcttaaaaatgttcctgtgaggttgctattgttgttagttcattcacttttgttgttgttgtatttgtgctgctggattcctatcctcatattcagatactgagaamctttagagaaattcccaggaatccaaccttgcatggaataaacctgggagtcctactgtatactgcaatctcccaaagtgggtttgactagagawttaacagcagaaagaagggctgggaatggaatgagcagaaagagggaaaagaggacctaggagtcaggaaagtcaagtccagttctgctactaatttaaggtgtgaacctgggcacataaatcatttagttgctataagctttggttccttcaccggattattaaattgaactatttaataatttcctaatatcttttcccagagctaaaattttaagaccctttaacttttagctggaaccgcatctcagctggactttagatagggctggttgacctcagatctcccccacagggtctatgataacacagagaatgtcccagtcgtacccctgaggacagactggtacatgcttcctgattgctcttacacacttctaggctttataaagtgtayagtgtaattctccccaaaacatttaaatggattttttaaaaattgagggattcttttcttttgctcacgaaatggcacgccagtgcttcattagcaatattaaattttctcctcactaatgcacacttatttttctctgtgactatgtaattattctgtcttcaaatcattatttgaattcacaggaaccaaaggcaagagatatataggcttctaagataaaagaatataataaacaagaactatagattaattactctcttttcaataggactatctcaagagattttatctctatgactcagaaacaaaaaatgccaacagtttagaagccaaactcaaggagatgcaraaattctttggcctacctataactggaatgttaaactcccrcgtcatagaaataatgcagaagcccagatgtggagtgccagatgttgcagaatactcactatttccaaatagcccaaaatggacttccaaagtggtcacctacaggttagttttgctctggctcattttggcaaaaacaataaagcctgtttcctaggggtcaaacattgttttcttgtttgctactaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggaggtaagaaagattcctgtaggctaatcctgtgtcctgttttgtttgttcatggtttatatcagtgctcttttcttatgaagattaaaatcctttaatgagatatgattggtagatagatagttaatagatagatttagcaatattattataatttttataatctggtaatatagagccactttttatagcagcagttggcaaactatgatgcatgagccaaatccagcccaccttctgtttttgtaaataaagttttactggaacacagtcaggctccttcatttccctattacctatgactgtttgggctcaggctgcaactgtgacagagatcacaaagcttaaacacttgttatctgaccctttacagaaaaagtttgccaacccctgttttgtaacgtgaattattatttatatatacagtcatgcactgcttaacaatgggaatacactctgagaatgagaactttggcaatcttgtcactgtgctaacatcatagaatacacttacacaaacccaggtgatacagcccactatccacctaggctacatagtatagcctattgctcctaggctgtaaatctatacagcatgttactatactgaatacggtaggcaactgtaacacagtggcaagtatttgtgtgtctaaacgtayttaaacattgaaaaggtaatgtattgagctatgacattatcacaactactatatcactaggctataggaatttttcagctccattataatcttataggaccattgtatatgtgatctgtttactgaaagatcattatgtagcacatgactatatgtttacaatatatmtacctaacatcgatattaaatcaacagaaagagtcgcagcttccaaaggcctcaagagtcccctgagaagtggtatatgacctgttgctaatgcctttcatgtggcaaggaagtaggaaatggaaactttcatattaaagaacwtaaaaatatataacacagcagggtgtggtggctcacgcctgtaatcccagcacttcgggaggccaaggcaggtggatcatctgcggtcaggagttcaagaccagcctggccaatagggtgaaaccccatctctactaaaacaaaaattagctgagcatggtgacgcatgcctgtaattccagctgcttgggaggctgaagcatgagaatcgcttgaacctgggaggcagaggttgcaatgagccaaggtcacaccactgtattccagcctgggcaacagagcaagactatgtctcaaaagaaaaaaaaaawatatatatatatatattttttttttttacgtgggtttttctatatgtaaaacccatttttttagtatatgtgttatatatgtgtgtgtgtgtatatatgtatatataaaacccatatacataaattgttcttaattgctagtgtttcatggtgcaaatttagagaaaaatgttgcccatttcagtctgttctatgtggaatggtccggctactgtagctgaaatttgaacttcaacccacaatattgacaacaccgaagaaaatgttatgggaaagcactaatcatggcactacaagttttttaagagctagataaactggactggcctcatatcacctcgaagataaccagctytgcatcacacrttaaaggactataaaaagccattttaagagatcttgagcatggctctctaagagactayttactatgcccacgaagaataagctaggtttttaagaaaaaaaaaaaaaaaaacctatgaaatggtgcacaaattacttgccaaatgtggtattcatattcattctccctcccaccaccctttggccgagcaaagtggtcaaatttamcaaaagcttaaatgcaaccttaagttagatataactgcattttaagtcctgtatccagtaagctttcaatatatggtgattatcaktgatgagcaatggttctgtgaaaggaaaagtgtctgggccaagaaagcacccaaactaccctgtgartgcaaccgacagcacataacaatgtcagctacttgcactgggctgccttttttttttttttaatttattttttgagatggagtttcactgttgtcacccaggctggagtgcagtggcgcgatctcagctcactgcaacttccgcctcctgagttcaagcaattctccagcctcagcctcccaagtagctgggattactacttggtggcatgtgccaccatgtccaaatttttgtatttttagtagagacggggtttcaccatgttagccagacaggtctcaaactcctgacctcaggtgatccgcccacctcggcctcgcaaagtgagccaccatgcctggcctggactgggctgctttttctagcctcaataatcgtataaactgaaaaataaaatgactggagaaaaaaaaaatcagtcactaagaacaatcactccattttctttcagctcatggggactcctacccatttgatgggccaggaaacacgctggctcatgcctttgcgcctgggacaggtctcggaggagatgctcacttcgatgaggatgaacgctggacggatggtagcagtctaggtatagcatctcatgtctcttctactccacatccgttttaaaatcctggacttacactaagttaaataattatattaatttataataagtattgagcccttgctaagtgccaaacactgtactatatgcctgaaatgcattatttcatgtaatatactcataatgctacacacagaagatggacactcaggctatggagtcaagcaccactgatccaatttgctgtacgtctaccaattactctgtgtcattgggcaagttattgaatttctctgagcctcagtttcctcctctgtggaatggaaatataaatagttcccacatcaaggagtctttaaattaaatgagataatgcttatacagtgcttggaatgtattaataattaattaaattatagctctttcttcatatttccaaaaaatacatgccccaaatggaaaagaaagagaagtagaaactatgatatttgagaagtatatgcaattctggaattattcactattttccagaaagaaccaactccatgatttagtatatcatatttatcattttacatagtaggatattataggcacatgagagaactaatggagaagagctctggcataaataatcccaattagagacaatttttttaaggctaccaactggccctaaaagggaaatttgtacttgtgtttggcaaaaggaattcaccatagcttgctgtcttgctgtgaaaatctatgttaaattgtgatgctgcctcccatttgcatctggcatattcttttcattcttctttcttcccacttaaggtaggttaaaggcagcttccttcaattcaatgcaacgccaccagagctcaggccactcctcaaacgcacgggctcacaccttccacatacttgcaaagcctttcaatgagtatgagggagaacaaaggatatatgtaatacaagttaatgaatcaaaatcaaaaacaaagcccagcattgcctagagaccctgcctttcaatcttcgctttctcaaagccaccattctctcttctgatatccaaagtcactaacatttattgaatggccgtgacttcccaaatattgagaaactctagctatcatgacaaatctagagggcagaaattactgtctctgtttaacagatgagaaactgagactcagcaacatcaattaatctgtccagagttgtccagctagtaagtagtggagctacatttcaaacctaggtcttagtgcttttaaaacctttgctttccactgcagagtattgctgcctgaatgaaagaagcaaataaaaaaaattacacatttttaataagcagaagtagtgatgagattaaagcactcctattctgattaaccttctaacccctytccacttttgaaagcctagaaacaaataagtaagctaccgtgggctaaaacttgggtatttttctttagtttttttaaattatgatatcwtatatataatattacataatgtatgtagctatttttatcattactgtttgtcacttcttcggttgtagggattaacttcctgtatgctgcaactcatgaacttggccattctttgggtatgggacattcctctgatcctaatgcagtgatgtatccaacctatggaaatggagatcyccaaaattttaaactttcccaggatgatattaaaggcattcagaaactatatggtaatatttattatttcaaataagaggatttcycattttctttttagagtggggtaggaaaagaaaggctgggaaatgggtatttacctggaaaaccacactggaactcatatcaaaaagcctattgaggggaggaattggggaccttagatacttaaaatataactaggctgtaatatactatgaagatgttgattgtgagtttcagtaacatagtatcatgtggtaaaattatgcaaatgatattgtccagattttcttcaagctgccacccactgctcttcctctctcagtttaaatagtttaggagagtgtccccygtaggggtggactgaagggacaaaacacctttcttcatagctgcccactcctaaggattcaatcctagataattataagtgaccctgctcttcctgtttgcacrtacatgtagagaaagcggttaaccacggacagaaactgcttatcattcctggtcttgatacttatgtatatcccttgccccagtctatgcttttttggtttaatcaagttccaaattcagtttttttaagtgcactgatttggatttactgtattgagtcagccaaaagtagtatttgagaaagaaatcaaaggacaagaataaaaagctctgtctctggataaagataaggaaagtaagattcaaagaggctaagtggactgtccaaggtcatgtgactgtcgagtgcttgagccatgattccaagtgagggctatgtgacttcatactttttctacgacatattcctgcctatcactacccagtaagctttttatcctagtaagaataaaagaatacagaatgacatctttaaatcagcagatataactaaacctagccagtaaaaatatcaggatgaagagaatacactgcaaaaagatcacttaagattcttcaaatgatcacgtgagcaatgaaagtgcttccacataatagaggactgtcctcaggggagaaatattccagtaagacactggatttaagatatcagttcaacctagcatttgctataaatcagcatgtcccaaactgtattctcagaacactagtcctacagggtgattcccagaaaaggaggctatggagaaataagttcaagaaacactacctactgtatttcaggtgtatagactattagagagtatggagtattgaacaaatgtttaactcagtgtttcctaaattataatcctttttatgggtctcaatgagtcccataaactagcacttcagagaacacactttggaaaatgctgtgtaactattcccaaaagttacgacgtaaagaamcactgctgtccaaaagattcacaaaatgctgactattgttcgtaaagttatcatgaacaaaactgaaaatactatcctccccttacataaaactgtggaactcatggaatattctatagcagtctataaatattttagaaccctaagaaaaatacaaagagactaaagaaggtctgaggcatgctgattaaatttaacaggaagaaaagagactagtgcattaaaaccttaagtattagacaaaagggcatctctggtcagagttggaaacaagtmacttctggacaaatggaaatagaatttaattatgtgggctgtatatgtagggagttaatctaaaaagtaatatgagcagaaaacatagattccaaagaaagtgattaagatacaagattcctaatgctatactcagaatgataaaaataatagctggctgggcgcggtggctcacgcctttacccagcacttcgggaggccaaggtggttggggatcgcttgaggccaggagctcgagacctggacaacatggtaaaaccccatgtctactaaaaatacaaaaattagccgggcgtgaaggtgcatgtctktagtcccagcaactcaggaggctgaagcatgagaattgccggaacccaggaggcagaggttgcagtgagtcaagatcacaccgctgcaatccagcctgggcaacagagtgagactccatctcaaaaaataaataaataatagctaacatgcattgagtacttgcagtatcccaagacttcacatggattaactcatttaattcaagaattcaatgagacattattatccacattttacagatttgtaatctgatgctaagagaggttaagtagtaaactacctaaggtcacacatctagtaaactggtagaaacaagatgcaaaggtacmtgagccctgggcccacactccagtcaatcctgccttcttagcctctggaggttgttcttcagaatctttgtcccagggacaagaaatggtctgagtgaataatagattatactttctgtgacatttcctttgcctgtataatcttaggatggtttttatgcattttctacatatcagaatgttctttttttttctctcaataggaaagagaagtaattcaagaaagaaatagaaacttcaggcagaacatccattcattcattcattggattgtatatcattgttgcacaatcagaattgataagcactgttcytccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttatttatagtttggagcactctttctgtgaagacatactatacaatgaaacgaaagactaagacaaaaaaagaatcccaccacactattttgaggtcttccgcagcacctcacccttccacccaagagggaaggtgggagctccacctctttattgttcattagtgtggcccaaagttacactaatttccccttacctttgtggcccgtgctctcacactgagtcctctggaaagtccaattcttcccacaaatgtctgagaatttccaacaacttaagacttaccacctcacggtcacttccagctccaagttcctacctgcccctcacctcctgattttcctgcaacctctcctgctgcagccactctctaggttcccttcccttttccccatgccaacgcagatgttggtctcaccctgttctctttaactttctacagaccagtgctacaggctttaatgagaatgtagatgttgctggagatttgcataaatagtggaattttctactgtgcaagggtcatgaaattgaacaaaactaaaattggatattatggatattatccccatccttcaaatccttttttttttttttkggaggcagtgtcattgttacccaggctggtgtacagtggcacgcgatctcggctcactgcaaccaccgcctcgtgggttcaagcgattctcctgcctcagcctcccaagtagctgggattataggcacatgccaccatccctggctaatttttgtatttttagtagagatggggtttcaccctattggccaggctggtcttgaactcctgacctcaagtgatccaccagcctcagcctcccaaagtgctaggattgcaggtgtgagccaccgcacccagcccaaatcctttacttatccccgatcaggaatttctcattggccacctgcttctgcaggctgcagcctcttgccacctgtctcccaactcctcttgtctttaaaccccactccttctcacttccccagaaactcattttcctgatgtccttcagctcaggtcctccctttccacacrtagaaacccactgtgtttctctgggtgaagcactctctatgcaaggtttaaccttttagcagaacacggagctggcaagggctttgctgtttcagccttctctttcttcctccttctccacactcccaacacccatgaatggctttctctatagggagatgaacaattgaaatttactttcttactgataaaaatyatccttcccacacataccctaaaagcagatcaatatcccgaaattcggaactatcctgcagccttaggaagccattccaagaatagatcaaatgagaggagaatccacaatccaggcaaaaaattaagtatatgtgaacaagcgttcaaagacccttttaaaacataaggraatatataaatatgatgctagaatgaaaaggaagttatgtcattaaattcaagttcttcattttgtagaagacaaaacagagattaaatgatttccctaaggttcacagtaagcaaaagtggtgatttaagcattttgttgtttgtttagctctttgtattttgattttagacagcaggaggcagtatctaccttgcagctaaagtggatatctattgttcttacctgcccarcatcccatcaccctacttctggggacaagaaactgcctcttccctttgtgtacaatcttcatgagatgtcacataggttgcctcaagctgcctgggctgakagaagagtacaggacccaagcttggcctatcagacactctcccaaaaacactggaggggttataggtggattcatcctggccatggggctctggagacactgcctagtgaatcctgcacccagacagattccctgaagctgccctgggccctgtccttctcatagcttaggtgtagggcttctcttccagatttacaactgacckcactgccttccagtacattttgtctattgcttaagttatccatagttagttcatttctgtggtttgcaaattctggcacagtagcttagttggctttcctagggtatctgcacacacgggctccgttctgtatttcaccacatattatccttcaatcttgacaatgaagtaagctctaacagagcatagaagtaaataaaatgttctttttctgatcaaatagcataaaactaactggtaaacaaaaatttttcctagcaaataaggacccatttttttaattgtggtaaaatacatgtaacataaaatttgccatctcaaccattaagtgtacagttcagtattgttaagtatattcacattgttgcacaagagaaaaagtccttaacctcagcactatttgcatttttgactatataattctttgttgtgtcctatgtattaagaatactaggccagacatagtggctcatgcctatgatcccagcattgtgggaggctaaggtgagcagattgtgtgagcccagatattaaagaccagcctgggcaacatagcaaaaccctatctctacaaaaaatttgacaattagccaggcgtggttgtacgtacctgggctcccagctacttggaaggctgaggtgggagggttgcttgagcccaggaggtcagggctgcmgtgaggcatgactgtaccactgcactccagcctgggcaacagagcacgaccctgtctcaaaagaaaaaaaaagaatgcttacagttaaccctggcctctatgcactgatgccaatagaatatcctcagttctctcaaccaaaaaagtcttcaaacagtaccaaatatcctctaagaggaaaaatagcccccagttgagaaccactgagctaaagagaataaactatttcattgtattatacttagtatcccttctaccattttcacccaggaccctatcatactctaattctgtaccatcccatgagaaaggaaaaccagtaaaagattaaggtgacattgcctgtttttgacacttatttgaggaaaagattgtcatattttaagaaataaaaaacacctgaattccagctgggcacgtggctaacgcctgtaatcacaacactttgggaggctaagrcaggtggatcatttgaggtcaggagttcaagaccagcctggccaacatggcaaaaccccctttctactaaagatacaaaaattagccaggtrtgatggcaggcacctgtaatctcagctacttgggagactaaggcatgaggatcacttgagcccaggaggcagaggttacaatgaactgagatcaygccactgcactccagcctaggtgatagagygacaccctgtctyaaaagaaaaaaatctgtattccaaagccagggtactawgtatttatagaagtccataagacttgggtgtattttgtaaattacttgttatttttctggttttaaagtcaataaactccagtttaagaaagaggtcttagcacatgaatttgtcttccctcccttcaaagatttcttttaagcagtagtgaaggaataaaacagagcaggaggaggtctgcaatggacaagggatttcaattaatttctgtaagatctaatacagctaatagacaaaacataccagcctcagcctaggatgtacaaagaggcctacagtgaaaatgggagtyaaaattgtccaactcctcagaggctttgaaatctcagttagaaggtttaatgaaggcagggtgaaaaatggtattaggcgattaactgtgtatgagtacatgtgtataagacaattaacttcatttcatccctttaacaaaaatggcagagagccagatgttcacttccaggcaaaatatcaaagggttctttgctaaacaagttttttaaaaaaattgagagagaacaggacatttaaattgggttctgtgcctctgaacaaaataaccatattttggctttgaggctgggaatagggaaggctccatccatctgctcatcctaacttaaatgtacgagtgaacaagaacatccatggacaccaggctcctagtcagctttcttgttgcattgttctgtggtggacaggtctaggcaaatctacccacaaaggctgaggaagctgtggggctgaagaaagaggctgacaaatccagtttctcagaaagaaacatttaatagtgacttacaaacagaagccttatcttgggcagccataagacgagagggtggattcctgcaccattacccgcagaaccagtactcacatgccatagggaaagggtatacatgcttcagaagggacaggtaggacaaccatagcacagtaacgtcaaggttgttttgaccagaaatttatggtaagtaccttctcttacacaaggaacaataaataagccggaaatcttggargccttcacagaactggggttaatgacmagataacatggtggattaacatccmagatggaattgctttagtctccacaccccttatttaaatgagattgggaacaaaataacaactcattgaaaaaggtggtgataccaaaaaaattcaccccagaaaaaacagaaataatttacagaatagaagaggtatgagaaaaaaaaaataggacattctcacagaaattkgggacgacattacacacataaaaaacagtaaccagccaggggcggtggctcacgtctgcaatctcagctctttgggaggccaaggtgggcagatcgcttgaggtcaggagttcgagaccagcatggccaacatgatgaaacccgtctctcctaaaaatataaaagttagccaggcrtggtggcaggtgcctgtaatcccagctacttgggaaactgagggaggagaatcgcttggacccaggaggaagaggttgcagtgagccgagatcgtgtcactgcactccagcttgggagacagagtgagactccatctcaaaaacaaaacaaaacaaaacaaaacaaaagtaatactaagattatattaaaaattatcagagaataagctgaaacttttgaaaattgaatttatgattgtcaagagagaagtataatgtaaaagagttggaagataaagaaagccactcagaatgaagagctgaaagacaaaaaaatrgaaaataggacagaaaaaggaagaagaaaagatcaattcaggaggtccaatacccaaytctgtcagctttgaaatatgtcaacttaactaagctaaactttatttcccagaattcctttctctatgtttcttgttagggctggccacaagaaaaatctacatggaatttggaccatggaagtaaagtaatacttgctctaccaaggttgatatgagtctggtgctgttgcagctcatgcacaatttcgtggttctgctcattcacattgtgagcacaaaacactgcaggcccagggctccagctcccacattatctcttccttcaacttctccaactcctgagttaggcctgagtgtggatccacacaataatactagtatcttctatggggcacmcacagaagcaaggttagagacctagcaacarggagaagccatcacaagcacctgtgatagaaggagaaaagttccagcttgttactcatttcacaggtcccaggtgtcctgctctccccactttacttctatcttttaactgctaacacctgtcctgtaacttcaagttcagcaccagatgcagaagaaacagccaaatcaagatcgttttaccagctcccacaacggtatgagtataaatccctataagtcccttattttacatcattcttagtggttctgctcctctcattgaaccttgtctgctacaacagccaataagatttccaaaaatgaagaatagacaaaataaagaatagacaaaataaagaaaagaaaattatcaaagaaataattggacattttccagtcttgagaagggtgaatggtttggagaaaaacgaatcttcaaacgaaagagccaacatcacgttaaaattttagaacaccaagaataa

SEQ ID NO: 13207 - DNA, 13119 bp, Homo sapiens
gctatattgcccaggctggtctcaaactcctgggctcaagtgatgctcccgccttggctttccaaagtgctgggattacaggtgtgagccactgtgtctggttgttctgtcttaaaacatgtatagaatgtagacttcctactacctctatactactaccctagtactagcctccatcttttcatgcctggcttgctgcaacagcgtcctacttgtctcactgcttctgcccttgccctgctacaatcttttctcaagacagcaatcagaatggtctttcaaaaacatttcagatcatatcattcctatgctcaaaatctcccaaaagttccccatttcatttgtgtcaaagtgaacaatctcatgaggtcttgtgtgatctggtctctcatttcctctctgacctcatttcctacctctcgctccctccctcagttccactccaaacaactcctggaacattccaggcataaagcagtttcagttcctctcctgattgttctgtctgccagaaatgttctttcactagatagccgcaagctcagttccttcatctttcaaatctttgctcaactgtcaccttctcaccgtacttaaaattgcaatccacttctgcttctaatcccctttccctgctcttttttctcccatactttgtatcatttcatataatattatatacttatttaatatgtttattatttactttatgtctctctccaatagaatggaagctctctgaatgcagggatttttgtctgttttatttacaaatgtatctgaggcatctagaacagtctagtacctggtaagcacccaayagatacttgctgaatgaatgaaaatctgttgtctgggtgctctgaggctgtttcccaggcaattctcacaattatacctgaggacacccctctgaggctctgtttgcactttgtcattctaatgggtcagaggcatatctaatcacaggaaaaataacattgcccaatataataatgagagaagatattcttttccaatggcagttgtgctcagacacattttaactctcctgcctcagggagcatttcctatatatgaacttcttccacagaaaggggaagactttgtatctttgtttttgtgggccatactgtttctattcctgatcttgttcacaggttatcataatccttaaactcttttaggtcttttgcactaagtttgaaatcctcttcaacaccacaggaatgctgctcctgagatctggatgctgaatagaatttctataagttctggaaaacstgttggggtaggtggttaggaaatcttacagcaggattgttaaaaatccaagcctcgtaggatttcctcctacaaaggaactgctacagttctgaccactaacctgaaataacagaacaagtcaccaggagatgtgtgtacacaagggccctgaatcttcttggagtgaactcctcttcccctgcctatcatacatttaaatattaaatccaaatacatatttcttctctcaagaactgttcctttacaaaacctgtctataaagcctgcaaaaacaactaatcttcttaggttctttgtaaattctattgcctgcctttctcaatatcaaaacagacaaaaaaacaaaaataaaaccttgggcccccctagaatatgggatgactcatggtactctgctaggtcacatttacacacacacacagagatacatacacacacaaacacatacagatacatacacatacacacacacatgcacacatatacacatatatacacacacacatttttctctagaaaaatataccctttcctaattttccctagaaggggaaaagtatacatctattggcttttgatatgtcatttaaatttttagtaggttcccttttatatttcttcctcaaaaatgcctttttcttctattcttgtagtctgaattccaatttctgttcggtctctacttgcagtgtggtaagactatagtgcactctcagcacattgtgagtagtaacaagccaaaaaccaggggtcatgtccaggttcagatgctcatgtgggagaggtaaaatattgatatatagaggcaaaagtggagtaagggggaaggcaaaggctggagctgaagttttgaaagaaacataccttatttaatgctactgactgctcagaagtcctagcatgtttaatttgccagaacttcttaatatcaaattgctcttgtgtctgaaatcctggttctcttgaattctctttttttttgagacggagtctcgctctgtcacccaggctggagtccagtggcacgatctcggctcactgcaagctccgcctcccgggttcacgccattctcctgcctcagcctcccgagtagctgggactacaggcgcccgccaccacgcccggctaatttttttgtatttttagtagagacggggtttcaccgtgttagccaggatggtcttgatctcctgacctcgtgatccgcccgcctcccaaagtgctgggattacaggcttgagccaccgcacctggccggttctcttgaatcctttgttgtgtagtaatgaatagttttctatcttctttagtattaagaaatggcttttctgatcttctgagaaactaaaacattatttctaattttagatttcccctcacttctcaaggcctcaaacacaatatcctctaatgacattgtctttggggtgacccaaaattatcatttatttyttacttatgagcagagagtttgcagcttttacttgccttgtctcttttaatacctacagccaccccctgggagcagaggagggagtgtgtataaagtatcacatttccacagtttgccatttatttccacttaagctgattacaggttgtgtttacttttcgttattccacagcatctctttagctctgtttcaatrgtaaatccctccaacgtgccagtctttctccctcaactggattcgatctgaaaagtaacttaataaaatcctaactgtagactccctctcccttggggtcaaactagaaccccactgaggaaggaactcctacaaacaaaaaagcaggagtagcccttcttgagctggcttgacattattgattctgcgtgggtgccaacatcccagtcatctcaaagaggagattttgtgaatgaaacaacatgaagaggtgaactgtcttttgagaacataagccagaggtagatgtcctgggaatgtgagtgctacagcactgggtaggtgaaaggagatgcctacttccacactcaaacagaacactgcacctcatgatttgctgtgcagtgggagtgggtggttgacctagaggctttgattcagacccacatcacaatttccctctagaatcttcttatttaataactgctgaccctgctataataggtctctgggggatacaccaattctctttcaatgttctggccaaagagtggacaaaaatcccttcccttgatttcccaagacttgggactctcaagatattttactaaatgacaatgaaaaacaaataaatttaaaaaattataaaaamaataatatccattgcagagggtacaacagttacttaggaatgaggaatacaaagtattgtgaaaagtctgaagaattgacaaatatttgtggctggtttctaggaaatttctccttgctgagaatagctttatctggctacccagaaggtttaagtcccttccacagagtcagttcctaggagtcactcaggatgtggtcttggtgattgggcagaatatattgctataaagtctgagaaaagttttaggaaaagtgctgggctcagtgactcatgcctgtaatcccagctcttaaggaggcagaggtgagaggatagcttgagtccaggagttcsagacctgcctgggcaatatagtgagcactcattctcaaagaaaaaaaaacattttaagaaaagtttaaacatatttgtgttttttaaaggctaccttagatacaaaatcattgtcctgaaattttacagttggactgaggtggggtatagtatatctcttgggtaagcagagtatagatggcctgagaacaatttgttgctccttcctttgccacctgcatatgtgaggataacattcttttgcctgtatagaaatgaagtgtgcatttaattttcagtgtatgggtattcccctaggaatctctctagtcctagccatgatcacaatgtctgaatctaccataaccagccccctctcagacccatataccctgtcacattctctgtaagatactctccacagaatatgtctctagctctgctggcacctccctgggggtctttactagcttactcccaacttgccactccatggagcatacgttgctatacttcccaccctggactgcatcctgtatgccttgactctcaggaggtccagactatgggcatgataactagcaaccactatggcgagcaagattcccactgcaccaacagtggctctccacctgctctgggaaacattcttccttaggcactgggaatgagcacccttttcaggtaaaataccacccactaaatacaggggtgtcactatcttctcacaggcccatccataaaagagtagcataaagatagtaattamattatttaacattttctgatatttttgttattattctaagtactttatacaattaatttatctgacattatttaaccttcaaaacaactctataaggcagttactattttattttattaaatttacaaaaataataatttttttatttaataaaatcccccattttatttactttttaattaattttatagagatgagatttcactctgttgcccaggatggtcttgaactgtctctattatcttctaatcttgacttttttccttatacgctacaatactccaatgaatattcttgttgattttttttttcacacctaagtgtttctattggatgtattttttgaaatggaatttttaggtgataaggcttacaaatttcaaatgtttaatagatagtgcctaaatccccttcaaaaatgtttgccaatttataaccccattatttgtgttccatttttgaaagatataaatatgtgtgcaaatcaactgctccgcatgggtagttccttacaatttctgtaatggaaaacatagagggaaaactacttgcagtttcagtgggagaaaaggttcccgtttcaagaaaagaaaatttcagtaggagaaaatattgtgaaaaacaaggtaattttctactttaagtttctgtcctatgggtataaaaaatagctggacattatcttcttcccaggctcttctcccctcttctccgtcaggctgcattgctggtcatttttggctcctgttggaagcaaactgctctaatgcctttggataagattttaaccaggaattatctttttttttttttttttttttttttttttgagacggagtctcgctctttcgcccaagctggagtacagtggcgctatctgggctcactgcaagctctgccwcccgggttcacgccattctcctgcctcagcctcccgagtagctgggactayctgccaccgcgcccggctaaattttttttgtattattagtagagacggggtttcaccgtgttagccaggatggtctcgatctcctgacctcgtgatccacccgccttggcctcccaaagtgctgagattacaggcktgagccaccgcgcccggccgaccaggaattatcttaaacagaaaaagaatactctaaggaggggtataccggccagcagaacagtaacccctccccggggttttcacaaggacacaagctggtgtgtaatagacttatctataaagcagactcaactcctaactggaattgttcctgattggttagcagaaacagaattgaggactgacgacagctgcacaagaagatgaaaccatttccttcctcttttctaagcttgtctcttaaaacccactggacgttggcacagtgctgggatgactatggagacccaaatgtctcagaatgtatgtcccagaaacctgtggctgcttcaaccattgacagttttgctgctgctgggtgagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacrttgatccactctcttctcttttacagcttctgcagacagtcaagctggtgagtatgccctttgcttccttgtattgacagtgttgtatcctcataatatgatgctgtgtttgctggggcggcggrggggtatgtctattccactgaaaatcaagcttgggttcagcatgggcagttcccccattttagtggggtctgggatttgcttcttagatccactgaagacccaagggaatgaggccgctgcaagtacagatcttgaactacatctacaataggactcttgggtgcctgacctcccttgggagctcctttggcatccacagtcccttcagggttatttattccacacccctttccactctgcccctcagcagctcccccaaaggctgtgctgaaacttgagcccccgtggatcaacgtgctccaggaggactctgtgactctgacatgcyrgggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttgtgagttgctcattcattccccatttcacccacccyytttgcttagcatgcgtggtgggggaagggggaatttctaataattttctcagcatgtgttaggttgtttttgcctcagtcttgattgagcaagggggttacgaggccacaaacagctgagtgtgggagaagcagaaggaaatccctactttaaaaaactaccctcctcctgtggcaatgcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagstttatgtaaacatctgacagtgttcagtttaatagagtctgtagagaaaatgcttctagatagtatttctttttttttycccccaagtagctgggactccaggcacacaccaccatrccaagtgacttgtttttatttatttttatagagacagggtctcagtatgttgcccaggctggtcttcagctcctggcctcaagtgatcttccctcctcaggctctcaaagtattgggattataggcgtgagccaccaygcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaaaatatagataataaaaattgagggctgggtgtggtggctcatgcctgtaatcccagcactttgggaggctgaggcaggaggatcacctgaggttgggatttcgagaccagcctgaccaacatggagaaaccctgtttctactaaaaatacaaaattagccgggcatggtggcgcwtgcctgtaatcccagctactcgggagactgaggcaggagaattgcttgaacctgggaggtggaggttgyggtgagccaagatcacaccactgcactccagcctgggcaacaagagtgaaactctgtctcaaaaaaaaaaaaaaaaaaaaaaaaaattgagatctgaagcattgttagagagaaactacctagtcccacctatccattgtacaaagaaatgcaactgattagacccaagagctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcctggccaacatggaaaaaccccatctctactaaaaatacaaaattagccrggcgtgatggygcatgcctgtaatccagctactcaggaggctgagggaggaggattgcttgaacttgggaggtggagtttgcagtgagccgagatcgcgccattccactccagcctgggcaataagagcgaaactccatctcaaaaaaaaaaaaaagaaaaagaaaactgtttttttaaatgaatttttatttaaataagatcgaataaattatatttattcctatgatacagcaatttgattttcatctttattaagtctattgaaactttgttaatagatttgtcctccgaggtagctgaattttggaatctgattactctgccatcagtgaagggaaggaattgttgggagtgaggatgtttgtaggcaaaaaggaaaaagtgattttaaatttaaaatttttcttgaatgccccttttattcagagtcacaaatgaatactgaattcacctgtgtgaattcaagtcatrcctttttatttcttatgtggatggaakattttatgcagggtayagtatggtctgaatgtttctgtgcccccaaaattcataygatatgaattaatcaaatarcaacccccagggtgatggtattaggaggtgaggtctttgggtaggtgaytaggtcatgagggcagagcccttataaaagagggccgagggagctcaaaggcctcttccgccatgtgaggacacagtaagaagcctcagttctgtgaaccaagaagtaggctcttatcaaagaagctgtaagcaccttgatcttggactttccagcccccagaacagggagaaataaatttctgttgtttataaaccacccagtttatagcattttgttatagcagccagaacagactaagacagggtggatgagggatgattaaggctctattttttttttttttaaccagcaacagcatgtggaaaaaaggggggaagaaggctctacttctttgctaatacagttcaaggctgcccaccctcacttcccaaagcttgtacaaaatttaccattaaattagtaatccccagaccacaaaaactgacggcttcaggccctgtcgagtagcctctacagttactgaaatgcgctcatttctctactcaaacrtagtattttaaattcctcagaattgttttaaatatctgctctgcatctttgaaacctctgaaaacttctgcttttagaagtcccayagatataataccatatattgcctataagagaatgctcacatctgtcatgaagcatcttcatttctgtctgccagacatcatgtcaagttctgtgagtaacgtacctctgagactgaaaaacccttggaatctatccttacaactttttcttatcatatttrtgtctttcagaatggctggtgctccagacccctcacctggagttccaggagggagaaaccatcrtgctgaggtgccacagctggaaggacaagcctctggtcaaggtcacattcttccagaatggaaaatcccagaaattctcccrtttggatcccaccttctccatcccacaagcaaaccacagtcacagtggtgattaccactgcacaggaaacataggctacacgctgttctcatccaagcctgtgaccatcactgtccaaggtatgsggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcattgatgcagaggttccctaagctcctgggcattcctaagagctgaggtttgcctcgtttcttctcatggctcatgttatagccattcactccagaaagcctggcacgtcatggactgttcaaggctgtgctccatagagtaatgatgcctccagctatgcgaggctttgggcccaccctccgtactgtccccaggggmtaaggggaatccttccctctgctcstgcatgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccratggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcattccgatctaggcccaccttttatttattagttcatttattagttcatcctcaacaagagcactaataggagtcacctcacagggttgccatggggatgaaagaggctgatgctcttacaccagtgcctggtaggcagtaacagcacacaaacagggctgttgccattctggaggaggtggtatgtgagrgcagcgcttagctagggaaggaggactctccaggcactgggccaaggcagggactgaggctgggtggggcttatatgakgggggagtagatagggtactgcaagcctctgagaaagagaaataatcccactaacacctcacaaagcactttgcaattggttcatagccaacacctcagttactgatgataagtaaatacagagaaacagagagagagagaggcagactgtgagacacaggggtgtttttaaaaggcagagcaagcctcagacagatgccatggcgtggcctttctgacactcctgggcgtccccatgggtgagctgaattctgcctctggactagcccttttccaggtgggagcagccyctgagcaggggaactgggggtgggaggacaggaaacatctgccagagggaaggcctgagctggtcccatccaatcctggccctggtccttggtcctgaggactcaggccccacygcctaatcctgctaacctcctgtgtgtccctcccagctctcycaggakaccctgagtgcagggaaatgggagagaccctccctgagaaaccaggtgaatacagagttgtctcagggattcagtgatggctcaccagggctgccggctggacctgagccagcgagaaggggcttgtgcgagttcagytgggagccagggagggagcagcgatggggggatggccrgggctcaamtcgcttggtcaactctgagtctaatttctgggcctaaagaggacctcgctggagatgagaagagaaacaccagtcccagatacagaggagagggckgtgttcraatttctrgkaccaggaatctgrtgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaataagtgggtggcccagggtgacctctcaggccttctaggt

SEQ ID NO: 13208 - DNA, 13428 bp, Homo sapiens
catagctaatggagtttctggcccctataatacatgggtggaagaaatatttttaggtccttacccaccctcattctgtacacccggatgatatccccaaccagaccttccagttagaaaatgakgatcagatgtctgcatgaggaaggagtgggttattcagtaaaaggttgtagcagacagamttgcttaccaactcaatagtcatctccctcttcctccttgtggaaagaatccccatttttaaggtaattcatcctcctccgcatgagtctgtgctcctctatgccagtcatggtcgttttatcccccttgccagtgatcagcctagttataggcatggtgaaattcaggccactgtgatgtgagaggaggtatgctggagagattctgggaaagttttcttgaatgataaaaataagcatacaggaagaggccttcctcttttaccattgaatattgccatgtctggaaacaatgcctgaccggcaatagccaccttgtgaccatgaaagttgctaaataacatgctgaggtttgcaaatcagaaagatggaaagaatcaggattttttaatgacattgttgaactgctgaattaatcagctccaaagccacccactactgaacttatatgcaagataatatatttccttttttaaaaacagtcatctaagttgggattttctgttattgcaactgaaaacatagcaaaagattcaagtgggatgtggatgaggcattagctcagtgggggaggacggaacggagatagatggattaaatcgcagaaacagatttcctgtgctgtcctaggtgctgaacaaactagtcctggtctccactctaaggttgttaacagccttgctggagataaagttggacatgtagaaagacaaaaagggcacactacagagaatacatatggacaaagttaacttgtgtacaactatgtgaagccagtcacttcccaatgattttattagtaagtttagacatccagggcttcagatcactactcctttccattgagattgagtgactttcgtgttccacttactctcagcaggtaattccatttgttcacttcataaagaaaattcagccaattggagtggacctcacaccttccaaatacacgtatactttaattctcaataacgacaatgagggcactctgctgggttccttacakgcattgcttcattgtcttctcacaacaagctaggtgctagcatcctcattctacatatgaggaaatggaggttcagaaagacttatccatagtcatagccggcaggcgatggagccagagttcaaccctaggtctgtctgactccaagcctgcattttttccactatatcacttaccttccctccctcattttcttccctctccctcccttcctacctttattcctcctttctcccctccctccctccttccctccttctctcccttccttcgttcctttcctcctaactcagataaagagattagaaatcatgcctcttccccctttccttcttaaagccccaaggaaacagcaaaccttgcaaagaaactgtcatcaagacaattacgaatattagatgtgaagggccaggagggagaggactggaacaaactggaggagtagggcaatggaagggtgtcagcaataatggtatttgtacatcttatttatctctgtcagggaaaaaatagtaaacttttcctgcatactaaattccagacatcaatgagatacccaagtgtgtgtgtcctatagcaaacaacatatatagggcttagattatagatgtgggaaccattcagttcaacaaattataattaagtcattcattcactcaacaactattattgaacatgtactatgtggaaggtacttgttttcttaactctgaattggaaggcattttttgggggacagcagagaatataatttgaaaggaaatatctagaacatatgttataataactttacctggaaggctatgggaaagacagaggtaaaatgaggtacatgttctcaaggagctctggttctggtatgggggtgggaggatcaggaggagatggccaaaaacacaaatgagtataattctaggctgcctgtggtatgtgccatctctgtagaaatcaaatgtgataagagtgtgagagaaggagagatgcattttgattagagagagatctgtatgctggagtctcttggccattacaatttttgataacctctgagtcatagttgaaatcatgagagtggatgttccaagagagaaggggaagagagggtgggggtagggggagagagatggtggagagggagagagaggagaggagaggagaggagagaggagaggagaggatctttgggggaaggctcacatgttggggaagtaggggaaaaaagagccagggaaggggccagaaggaacatccagaggaagaggagaaccggagtaaagcaaagtcacaggaaccaaagtaaagaagagtttcacagaagagagtgaggctgatctgctgcattccgttcctcttggccctgggtgaggacagtaaaagccaggcaggtgtgccggttggggagggttgggagaggtcttttcctgaaatagccactgggcggcagtggtggcagcagcagcagctgcagctgtgtcgggacatgcagaaacgtagcagagctaagtcaggagaaatgtagcagaggtaaaccagcctgaagcagtaggagcaggaagctggctcaggctggggcttctctagtgtagtgcttctccttgggtgtacaccaaacttcaaaacacgcttgtccacctctgcagaggccaggttcattcctgggagcaaagcagtaacaaraaacaccttctaaacttgcagcattttatggttcacaaagtgctccacacctgttaaccaattcaatattcaggaaaccctaaaagattggtattattattattcccatttcactggtgaagaatggaagttacaaagaggcgcccaggctcacataactaataagtggaagagcaaggatttaaacaccagcccgtctggcttcaaaaacttgggcctcttatgtaatgtcacagtagtcagctgtccaggactcaggttatgactgtgtcctccactgctaccttttattccaccctttactctgccacagggcaaggatcttcagtttccccatccaggtttctgggctttccgagagatctagattctagattctagaagtccgcctcctcctctcactcccaggatccagctgggtgacattctcaggacctgaggatcaagtaagttcagagtccccattgcttctcagctccatgcagagtggattctgctccagcctgctcacccctccccaaaggcactgcttacctcatcctcagagtcctccagaccgggtttgcctctagtgcctaagatatacttacggaggcttagttggcttcaggagccccagatcctgagctgctggcaattccctacaccaggctctcaaacatctaggcttgctctctgcaccttctccactatattcagaccaagtctctgggagtgatcaagagagacgaggggtactgtatagaaaggggtagagtctgtatgggaaatgtattggctggtatccttaaggaggcatgaactgtctcctggccatcccctcttacatgtataataggcatctcaaaatttacaggctgaaaagtgaactcccaatctttcccctaaacccactcctgtctctgtcaacagtaactctattcttccagttgctcaggcyggacattttggagtaatttttgactcttctttctcttataccccacatcagtaaatcttgctgtccctacttaaaaaagtctatccagaatttgaccacttctcatcatctccaccactgtgatccaagctaccatcatctctatcagcaatagcctcttgactggtcttccccctgtacctccagccctgcagtctattctcaatatagagctggccagtgagccttctaaaatgtaagtcagatgacacctctcttctctaaaccctaagtgccttcccgttcaccaaagagtcctttacaatggcctccaaggaccttcatgatctggtccctgccaaactctctgacctcattttttacttttccccttctcacaacacctggcctttattcaaaagtcacccttaatatttatttatttacttatagacagggtcttgctttgtcattcaggctggagtgcagagktctgaccatagttcactgcaacctcaaactgctgggctcaagtgatcctcctatctccgactcccaaagcactgggattacaggtgtgagccactgtgcctggtttcattcctaatatttaaaacracaaccctctctattacccttttccttccctctttattacccttttccttccctctttaatttttctccataatgatgatcacaatctacatattttacttattaattttattatcccccagtagtatgtaagcaccattagggtgggagtttttatctattttgtccactcctaaggaactaccagtaactagaactggaccaggcaaaagtaggctctcagtaaatattcgtggttttaaaaaaattatttatatttgagacagggtctcactttgtcacccagattggagtgcagtggcgcgatcacagctcactgcagcctcaacatcccaggttcaagcactcctcctgcctcagccccccatgtagctgggacatcaggtgcatgccaccacgcccgactaattttttgtagagacagggttttgccacgttgtccaggcttgtcttgaactcctgagctccagcgatctgcctgcctctgtctgccataaatatttgttgattctttcctggatcatagccagtggcttagagaggcaacttaagcatagcaattaagttatggatgctagagcctgatccaaaggcaggcctgtcttggttcaaatcttgactctaccactaactagcaagacacctaaactttctgtgccttcattttttcatcagcaaagcagagacaataatagtatctagctcatagagagcctatggggtcattaataagtataaagcacttagaaaaatgcctgtcacatagtaagtgctatataagcattctttgtaattatatgcatatgagatttatattaaatatcagtagtttagattttctaaaatctttcaatgtgttgtcttgcacttgcccatgtgaaaattcgtttcccatgtttctgctcacttacacaggcttgtatgatccccctgtaatctatctccagggacctggctcttcatcagtaaacttggatgtttcctcgtgttctccctcctgcagtsatttcaaagctgttaaatagtaatctcgctggrccccagtttcccaatctrtacaatgagtgggttggactaggtcatcgtaaagggcctttctaactcttttaatctcccaggtgggaggagggacaggccccacctccaactccacctccttggatatgccctctggctgccaaggggaagggtgacagagtcagctgagctcarcttcaaggggaccaggtaggagatgtgccaacgttcttgggcaagggtggcaatggggctcctgggctgtaggcaggcagtggggaaggtgtcataggtaaatgtcatctggagacactgtgaccagggcactaggagaggcgaaggcactgtggggagagacactcctcttccagggatatakctgtgatgacgagtcagaagacactttgggtctgggtatcttcccactttggatagtgctgggaggcctccaccctcttcagccagccaggctcttagggacagagtgagctgcagagtgagtacaacccaaatacacgggctgcctgcctgagccccagcactgcctgctgcccaccacttcccaagctggaccaagggagcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcargttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcrtgcccaacctgttctttgtcacaaccagcamcaaagggaccaccgtcctgtgccatgacaccactcggcytgaagagtttgaccactatgtgcacttcagctcggcggtcatggggctgctctttggcgtgccctgcctggtcactcttgtttgctatggactcatggctcgtcgcctgtatcagcccttgccaggckctgcacagtcgtcttctcgcctccgmtctctccgcaccrtagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccrtcagctctgtggtggtggcaagccccagccccgcacggctgcytcttccctggcactagtgtccctgcctgaggatagcagctgcaggtrggcggccaccccccrggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagctgaaggggtggatcaggcagagtcatctcaggattggcctgacgtatctgatggtgataaccagaatcaggaagtggaggcaacttccatatcacagatgccgaggatgtgccatatgtagcacccacactgacttcctggttctctctcaaagacagcatagtcttgcttaccaagatgctggaatagggtgtgatcccagggagcctgcatgccagggtccccgcatgtagctgggggcctgacactgttgaactggtgtgcagcatgaattaaagtcctgtgatagggtggggaccttagctgataacagcctttgggacaggaatgggactggaccttctttatgatgtttgctgagaacatgtatatgacagctctcctgtacttaacaaaaggacaagtggatggctcagactgagggggtggagctctcacgtctatggctgtaagttctagyattgaggagtagagcagatttgtgcagaggaaggtggtgacaagaattgacgcccagagctagtgtttcactgatctctccmctttctctaggtcctgccccaaataaatgataaatctgtcaccagctctttcagatcaggcttcaggactttgaggccagggtggagcactaggactgggaaggttctttttaaagtttcccacccattcattgcttctctcttccagtgccatcttagcacttacaggcttattggatcaagttgcagaggggaggggggtgcattggaaattgagaagctaacccctaagccttgggaagtaagaatttcttggcaggcattcttgagaagggtgggctcacacttacaggccttctccctctgaaatcaccttccagcctgttggtctcctgagtcagaccccagccttgcctttctttttttcccacccttgctaacctgtctctgatctcttacttatctaatgatactaactcttattggcttctaagcgtctctctctgtagagtagggctggggctggactgaaggaaaaaaaaatgacttcagttcccctgaatttccctttttgttttttgaaaggctcccactttctccctagatatccaggaccttcttgctatgcaggactcctgccattaggagtaaatgaaccggcttttttctcctcttcttactagttctcccagtctcacagccactgttgcgtacactgttcctcatctgcactctcttccttttattcctatgaccatggcctctttgcccatcacctcccctaacctgctgtccccacccagtaaagctgctctttccatcccaactgactcagcctcctccatttcctcagtctatttaactcccatatgcttaatcgagatgaactttctggtcygttactttagggctgtcttcccttgcactttagctttaaacaccttgactttcaccttaggccaatctcctttcttctaggactggaggaaattgcagatgaagccagagaacaaggctggcttgacccactaagacttcacatcctggaactttgcctaagctctcattcctcttagcctggtgtgttcctagtgaacattccacagcagctgtttcctgtctttttcacctccacaagtccccaaattcatctccttcttgtgatctcttaagagagttaccttgcctcctgcraaactgagaagctctaacgcttcaacttccagttatcattcacgataactactctatatttgccctgtctttctccctttcttccctgaagttccagaataagaggtggtcccctttcttattcctttgtttacctctcttcattatttcaagtctcttccatcacccattttatcccatcttaaaaacaaacaacaacaacaaaaaaaccaaagcattatcactgacaccttaaccctgctgccgtttgtcttttcttttttctttttttttgagacggagttgctctgtcgcccaggctgtagtgcagtggcacaattctcggctcactgcaaccttcacttcccaggttcaagtgattctcctgcctcagcctcccaagtagctgggattataggcacacatcaccacgcctggctaatttttgtatgtttagtagagacagggttgcatcatgttggccaggctggtctcgaacttctgacctcaagtgatccgcccacctcagcctcccaaagtgctgggattacaggcatgagctaccacrcctggcctagaaaccttttattgtaaatattctccctggttgctatagtctttcatatctattatttcagttgcctcataaaattacacctgtcagtagattacattttatttgactattcccctattattgaatatttagatatatttcaatttttctgtgctttgaacatcttaatgtgtatggctttttttcttctttgtaattctgtctctaggacaaattcccaggagtgggattaccagaccaaagagcatgaatgtttttatggattgtgactgccaaaaggactgcaaaaattttcaacaccacaatgacgtatgagttgttccagttcccttgcagcgctagcattggactttagaagaaatctctttagatgattaaacattattttgatattttttcatttctttgattactcatgtgattgaactctttcccatatgtttactctttgcatctttctttaattggcaccctagtggtattcttatatatctaaatgtattcttaatatacatgctatccctttgtcattatttgatgtaaatatttatcttatttattgtgatacttttaattttagttccttattttatcctcttgctttagaatttctctcctcwtgcttttatctctctgattactttctatctcctttgctgacttctcttttgctccttaagtaaacagcattcctgagatcggtcacagagtcatagcatttggggattatttaatgccctttgttcatctgactattgattttgccatggagaaaacatacatgcaggtgactcatagtccttgagagtacctcagagatcatatagggtctgtgcaccccctcactttacggtgaaggaaacaggcccagagaggtggcttgcccgtgactcagtaagttagtggcagagaagaggcaaagtcccaggtctcctgactcccagggctccattatataccattataccaagccaactcaattctaggccttcccttctcccaacctccacctctacatcttcaattgcctactagacagtttcacttggaccttccattgttacttccaccccaagatgtcaaaagcaaaactccctgaaccagtttttctacctgtcttgctaatttctgttcatggcgtcttctttcttcaagtcagctaggcttgaaaactctcaggcaagttcaactcttgtctctccctatttcacaggttctgacatttctttcttcatcttgccaattacaattggccttccttttagtctcagcaccaccattttaatactggcttttgtcaccttatccctgactgtcataggctcctaactagtcttccttatctccagtctcttcccatcgaaaggcatcctctacaatgcatattgccagattagtctacccacacactgctttcagagtttcactgtcttactcaaaattttttcatggttcactattgtccacaagacaagtcaaaatccttttgtcagaagttcaagagggtctttgaatcttactttccattattccccagtaaaagtctctcttctctagctaaattggkcttttcattctctttccaaacaagacttggattttctcacctccgtctttattcttcctgtcccccacactggaatgccctccctttcttcttgggctgccctttttctattcagtttccaaggccaggcttaagtcctacttcctgtttgaggccttctctgctgactcttacccacagtgaccttccaggtcactcctagagtaattattgtctctatcagtcattgggcacttttattgtcttttaacattacttctactgttatcttgaattgttatttaactattcatgtatgtttgtcttgagttcccacctataaaccccttgagttactgcgatagaaaggaaagagcatagaacagaaaatcagaagacccaagtctgagctctgattcagaaaatggggctcaggtgtgtcatcttggatgagtcactcagactctctgaaccacaatttcatcatctgtaaaaagaagacaattatctcagctttaagtacctcttcagattctggtgaagctttaagtacctcttcagattctggtgcttaataaatattttctgaatgattatacgttagtaattcagttttttgtttcttcttctgggtatatttccactttgagaggccacaggaaccccaaggaattaaaggccaaggggactttakgaacaatggtggtgggagggcattggaaagatgttttgaggggaagtagacataaccagcatctttcacattccactctgtgggctactcactacttggcctgcctgtaaggctaacctggatgtagggaggaggggaaggtgacacattctgagctttcactttgcttacgttttctattccttcatccaacaatccccagctggttaagtgaaatgcttcactcaggagtctgctctccttcattgatgtgatgaaagccagcttttggtaaaggaagtgataaggagtagtagagagaacaaacaattttcatcagataactggacttgactttgaatccttgatctgatactcactagctgcatgatctcgacaagttacttgatctctctgaacttcaatttcctcgttgataaattgggataagaatacccatttgacaaagctgttgcaaagagtcaatggagtaatggatgacgaaacatcacttacaattcctgtgggcaggaacttcctttcaatggttttcaactttagcatagctggacgtggaataagagctcccattcaagtactaatcaggcccgaccctgcttagcttcggaaatcagatgagatcgggcacgttcatggtggtatggccatagatcatggaaccagaactcaatatttgaatctgctgcttagatgtgatagttaagatcatgacaaagaataaaccttcgagtgtgagaagcagagggctaagaactgatcaccgagggatggccatagtgatggattgggaggaaacagtttgggactctggcattgcatcgagggagaagagagtttcagaaacagggatttaggatagttatttaaaaaacaaaaaacctttgaataaaaaaagagaacgattaagaaagcaatcaacagtgtcaaatgcctaagagaattcaaggaggatgtgattctcagaaacactcaataaaaaatacttgattctctgccaaactgggtttatgcatacaatagataatagccagtggcattgactaaagaggccaattttaaatagcttttgtaatcaakaactttttacatgcattagttggtgaccacacctctttccaaagtttcctgttgaccacacctctttccaaagttttcagaataacccatttaatgggttacttgccataactacagagctgatatttcctatatgagatgagatgtggcttctcatcaaaaggaagagcagaaatatctgagtggaaccaaagagtgagtatgtctatgagggtaccttggtataggtttgattaccagag

SEQ ID NO: 13209 - DNA, 16371 bp, Homo sapiens
tatttaagccttttaaagtttctttcagcaacgttttgtagttttaagagcaaatgttttgcatttcttttgttaaatttatcctcaagtatgttattctttttgatgctattataaatggaattgttttcataattttcatttttttattgttatacagaaatacaattgttttttatgtattgatcttatatcctgcaactgctgaactcctttattagttcttagttttttaaaaaagtgttttccttaggattttccatatacaaaaaaggttaatatcatccacaaatagatgtagttttatttgttcctttccagcctggacttttaaatttccttttcataactaactgctctgaaatcaccagcataatgttaaatggaagtggtaagagaagacatttttgttttgttcctgaccttagggaggaggctttcagtgtttcaccattgagtatgatattagtggtatggttttttggatatgcgacatattttcttttacaaataatagaccaataaagtctattctaaagaatagaccaacaaacaattgtccacttttaccctgtttctttaagaaagcctgagtaagaggcaaaattttggaaaatacttgttttgctctaaygtgctgcagttattagataacatttgcttaacagacagttatttttccatccttgaatttatatattgctcatagccatagagacttaatttttatgtgtgcattttagtattgttagtgtattataaatatggctaaggtatgtatggggtcagcacaatgccactggggcccccttctgtctgtggactccttttcatctgtgttctaacaacattcacacatgtttgctttcaataaaaatggctgaagtctgttcactgcccaggtagttggtccagcctcctccacagacatcaagcagaaactcccatctaaaaagctgggcttggctgggcatagtggctcatgcatgtgatctcagcasttttggaggctgaggtggaggattgtctgagcccaggagttccagactagcctggacaacatagtgagaccccatttctgcacacacacacaaaagaaaaaaatsagctgggtgtgatggcacatacctgtagtcccagctactctggaggctgagataggcggatcacttgatctgggaggtcaaggctgcagtgagccatgataacactgctgcactctagtctgggctaccgattttgagactctgtctcaaaagtcaatcaatcagtcaataaataartaaaaagcaagacttsctggatggctaccagtgaccacaggggtctttgataaagcttttttttttatatatagcagyaataacaaccatatttgttaaacagctgctgtcttccaagaaaagtaatagtcactgtatgtacattttctgttttattttacactaatcctacatattagatattatatctccagtttttgggaaagagttttattttacactaatcctacatattagatattatatctccagtttttgggaaagaacaccagagattgaaataacttagccaagtmggccagtatgtggcaaaatgggggctcagacatactccacattgtaattctttcatccttaccacaggccggtgaatctttgtttcaccacttactagctgtgtgacattggagagtcactgattctctctggccttcagcttccacacctgggcaatggggacagtcactatggatgtctctagggcagatgggaagcctaagacaggacatgcttcaatttcttccctatgcctccatccctgattttttttcacaattgcttattgttattagtggtagaaatgcttggctggaacaaattaaatccaacagacatttggtgagtccctaccatggaaaagaaaccatgctggatattgaatacaatcagatgccgaatccaaattctagggacttgagtgttttcttttttgctaaaatttattgagagctgactacggctcctctgttctaaatgctttacatgtataacccatttaatcttcatcctaacactttgaaggwgggactattcccattacacagtcaaggaaactgagctacayggggaggggttattagtcaaatcttaacaataaacaaaaacttgtgaatgccggagctgggtctccagtgcagccaagtcggctccaaagtccacactcttaattcaccctgaggctctgaggtcccccatccttgtctttgcaggtgaatgtgagaaaatcaccctggagaggacaaagaaacatctaccacaggtgctccaataagctctgggcactgtctagttacaaagcgtgctgttaggtgtaaggggatacaaaaatgtgtgggaatctggagtmtaagtgcagcaaaaagtgtggtatatgcatgattaggtacagggcagggagggagtggtgagtactaaagagctgagagaacgacctgtctatgggaatcacagacagatcagttctggttgggttattcagaaaacttgctgatggggaagcttgaactgggacttgaaagaatggaaagatttcagtgggtgaagagcctggcagacgagaatgttgctagcagagggagagacatgaactacagggtggagatgagcrgacaaggtgcttctctgacagtgagcaggagcctcccttgccaggatgtttcctcattcatggagaccagcagaacactggtccttgaagccttgtgaggtgcaaggggtgcaggctctgggtccaaattccagcatagccccttgagtgcaaattttctcatctgtggccacagagtagaggcactatcgcgagcatcttcagtgcggaggggaaagagtatgggctctcccagcgggtgggagcagcactgagggagtatgaggatcagagtagcctcagccacggtggagagctggagagataagcagcaaggaaaagagctggggacccaactgtctcagcataaattgagaaggcaggagcagtgatcaggggaaacaagacacaaaaactaggcagtggatgaaggagagcagaaagtcaaaggcaagtgcatggtttaaaacctcagtggaccaactattgatactgggaaagatggggtaagggtcccttctagaatactccctccccaatctccttggacactgctatcactgccaggggaatgggtaagttcaccaaaaggtgggttgtaaagagatgatgaagaccaccagcaaaaccttgagaatggccactctagtgggtgstacaagaggatcccaggggcctccccaaggctcacaggagaggaagggaggaaaacatgtgtctcaaaagtaattggaggaggagccttgagaatggtgaagggtcacaagtgcaaatggcaccaaggcttctagaaggatggctgaaaacaagattttggcaacagtatttaggaccagatgggtgttcttcaagggagctgtttcaggagtaaagcaagtctgctggtgggccagagtgagggygctgggccaggaactgggccaagcattgggaagtggatgtgttatctgcaaagggataggaaggagtggcccaccctggtgtgcagggggcacagataggaagatagggatggggcaagaacacagacaggggaccttcagtcaccagaaggtagtctaaaatatgcaaagcctccaaggtattggctggagargaaaaacaaagcggctgagggcaggccccacaargcaaaggtatcctgagggycakgggtaaagcccttacaggtgggaaagccaagtgggtcatgtccacccatccttgtgtagggcaacccagacactgtggtaccccccatgggacaatgctctgcttctatctgttgttgctctagtttctttctaatacagaaacatccaacatctgcacctcctcatatagggttgatccaagtttcacagacatcactgagttcttagtggactcagctattggggctgttctcacactttttttttctttgcaagaatcagcaatgggtgcaagtggacctgtgtaggacgtccagtgaaacattgtgttggtgaatcagctagaatccatccaagaactcagccagcctggtgtggggtgagatctgatccttgaatgtccctcagtggcttttagggctggcaggttcagaagggccctctcatcacccccccagggcctcattccttgtttaacactttgctatcacagtcttgaatccttgtaattgaacaatggaccccacattttcactttgcactggtttctgattctgtaaccratcctgtccccctctcttgtctcattcactctgggaattgtccccacattctgagacctttcagcagtgccccaacgaggttcctgcccttatctgaagctccaccctcacccccatggcggcaccgcaggcagccctgcttttgcgtcccgcgtaggcaggctgtgcaccggagtcacgaccccctgattcagcctaggcagccacagcttgactgctcccgccggacaagccctactgtgctatctgccgctcttcccttcctcttcccaggggstccgcgtcaggggaggcgcagctgtgtgcattccgggagcttcagacccccgtgtccagcagctccttcgtttcctgggtgctggggcggccttcccagcgaagagctcaactcagcgggacgtttggaggctctctgccccaaggcgctggggagtgtgcggcgggacagtcgtgcttgcctttttcactttcagagtgtccacgccccacccgtttggtcactgcaggtcagtccagtccagcccggcccaccccaccggtgygtgtctgtcgcacgtggcagacgccatactctctrttcttgtttaaagcccaggatctactgggccctggaggcaagaggtgaacgcagcggaatccacgctgagctgcccgggaacggagcttccaaccccagaaggargactctgtgctcctacaccttaaccctttttagcccgaaacttctccaacttccttggctttgtttagagctcgacagcgccgccccctggcgctcgttgtgaggacagtagaggagagaggcaagggtgtttttaaacagtttgcctctcaccattatgggggcgacccgagggggagacccactcttccgcattcccggtaagtgaaccaccggaagaggtcgaaagtgacggattcccatgtcctcctccagccccccccccaccctgcccatccacaggacggtggctcttcagtgccctttgccgagcaagtggcgtttctatgcacgtgggtatcaattcggactctggacgaaatggaaacctccttagccgacccgggtgggatcagctgggatcctgcgcgctcccctggggggttgccagccactctgttggggtgcaagaagcaccatccttcggaagctgggccgaaactggccaggctgactcgctcccacgcgcccgcccctacccggcgccgcagcaattcacctgccacsgcctctkagccgggtccggacttcggcgccctgacagtgtccccgcgacttccccacccgatgagatggggtctggcgttggccagtgcgtgtccagggactcgcgggtccctggccagccatggggcagagggcgctggtgttaggccagtcttccccaccctgccccgtcaccccagccacacccactgtcctgtgaggccaagcgcgctccgctggtttcctgarccaggcaccttggccgcggacaggatccagctgtctctccttgcgatcctgtcttcggggaagtccacgtcctaggcaggtcctcccaaagtgcccttggtgccgatcacccctcccagcgtcttgcaggtcytgtgcaccacctcccccactccccattcaaagccctcttctctgaagtctccggttcccagagctcttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccrggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacsgccctgtcgcagtgcccgcgctttccccggygcctgcacgcggcgcgcctgggtaacatgcttggggtcctggtccttggcgcgctggccctggccrgcctggggttccccgcacccgcagagccgcagccgggtggcagccagtgcgtcgagcacgactgcttcgcgctctacccgggccccrcgaccttcctcaatgccagtcagatctgcgacggactgcggggccacctaatgacagtgcgctcctcggtggctgccgatgtcatttccttgctactgaacggcgacgscggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaagsccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacargtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgyccgccacattggcaccgactgtgactccggcaaggtgkacggtggcgacagcggctctggcgagyccccgcccagcccgacgcycggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccrtccaggagcctggctycgtccaggagcctgtgcctcctcacccccagctttgctaccaaagcaccttagctggcatkacagctggagaagaccctccccgcaccccccaagctgttttcttctattccatggctaactggcgaggggrtgattagagggaggagaatgagcctcggcctcttccgtgacgtcactggaccactgggcaatgatggcaattttgtaacgaagacacagactgcgatttgtcccaggtcctcactaccrggcgcaggagggtgagcgttattggtcggcagccttctgggcagaccttgacctcgtgggctagggatgactaraatatttattttttttaagtatttaggtttttgtttgtttcctttgttcttacctgtatgtctccagtatccactttgcacagctctccggtctctctctctctacaaactcccacttgtcatgtgacaggtaaactatcttggtraatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtrttaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgmgagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcastaatttgaggacaaccattccagactgcttccaattttctggaatacatgaaatatagatcagttataagtagcaggccaagtcaggcccttattttyaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaatmaacaaataacaatgtgwtctcgggttgtgtgtctgttcacttttcctccctcagtgccctcattttatgtcattaaatggggctcacaaaccatgcaaatgctatgagatgcatggagggctgccctgtaccccagcacttgtgttgtctggtgrtggcaccatctctgattttcaaagctttttccagaggctattattttcactgtagaatgatttcatgctatctcygtgtgcacaaatatttattttctttctgtaaccataacaacttcatatatgargacttgtgtctctgtgcttttaaatgcataaatgcattataggatcatttgttggaatgaattaaataaacccttcctggggcatctggcgaatccyagctgtgtgtccggtgtatggtttggcattatctcctctgcgagatatccaaattcactgtagtcatgaagggtctcagtttgtggctctcattcaaatattcatttctaaacgtctcatccagtatgaaatcattctcatctcttttggagattaacaacatsatcttttcaatgcacacgtttcttgggctcacttttctaaggtggtagggctggctgaatgcaatatgcagggctcggaaagattttttaaagaagaaattaaaarcaagtagagtccaggcaaatattcagatgctttatatgtctggataatgctgaactcatgagttttagtttgactgattattgtgaagaccgggttggagattttgacatccatcgcagaagaagtaatggctttagtgtgtgtgtgtgtgtgctggggaagctccrtgcacagtgccctatggagataacaagctgagccatgctccccctaagtagcagactaagtctttgtgaargaagagctacacaaatgggggcaggacaggtgcagmtaaatggggctgggagaccagaggagacagtgacaccttatagttcgccccctgttaccyagccttctgtttgtcmaaagagtctgctcccagtcactgtcaaactgacttgtagggcctcattgcgttaggatttcttcttattccagaagaggggcattttcttaaggaacactggaagaccaaaacacactttcaaaacctagaggsaaaaacccttcatgcagcacttgggccccaggacattagttgtgcggggccctgagcttccctgtcctcctcacttcctgctgcctgggggatcagcagttctgtttataggtctcatctgaacttgagattctcaaaacgctaaatagccatagtgcctctcagggaaagataccaggaccacataaacaaatcagttagctttaaaaactatccctgagmatttaaaatcaggatagaccttgtgaaaccagagccatgggtcaacctgtgtgatctctgctttctgttcacatcattggacatccaggtctgagggagactcccagggaccagttgctggtgaaatttcatagcacaaaagtccggggcaagaaagccaaggtggtatttctggataagccagcattcaagtttgtttgtttgtttgtttgtttgtttttcctagcctgctgttttaaagtaaacagaatgcatttttttaagtcaaatgactttgttattttttttttccagttctcacctatttcttagattagttcagcaattatttactgagcatttactctgtgcctttcatagtgataggcacaatgacaagtccctaccatataagttagactctggcaggggagaaagatgcaaaacaactgatcacccccaaattgtacttaacttagaaacagtgataagtgcaggggaagaaaagcacagcacactctgaaaaggcgcacgaggaaggcaggatttagagtggaggactagagggagcttcctggacaagctgacacttaacaccagacytgaaggggaaggaggggtttgtcaaatgcaaactggaggggaagcagtccakgtgggaargatcacacytgcaaaggccctgtactgggaagagccctggtggagcggactgggcatagtgaacaaggtgaggtgggctgcaasgcagctgaagaggtggaaagagagatacaagcagtgggagatgactgtaggggctgtaggtcaaagacactgaaaaaaagactgaaagagtgacattgaaaaatgttctgggtgcaagtgggggcactcaaggagttttgatgagagtgcactgggattcaatttatgtactgcattgtttgggaagataacaactacttytagatgtatttacatgtccctcttgggcaggaacctgcacaatttccgctgtaagcaccccgcagggctgrtatgtggtgtgaacagcatacacacctgggtgtgaccccagcctgamacctgctggtcacatggccacgggcaccacatgacccttcaaaggctgtaagacgggttcaagcagtgccgcctcacaaggtttccaggaagattagataagctcagtttctggcccatggtagatacccaataactgtttacttgtgtgccagtgaactggtagatgcataaatgagtacagaaaaaagctgtgttggaatcatgagtgtcttacgggcaaactcaaggttgcacaaagtggatactgttccatcaagggaagatgcagttgcttggagcaatgttgtcaatgctagaggaactgtaatgttggatttgcaggcatctayatcatagcttaaacaggaagatttttgtgccaggtgagaagtgagctccaacactcggtcactctaaaatccagcttcgaaggcttcagcttattttcccttctcacaaggcttagtcaagtacaggggacagagactccctccgctgttctcccaaggaggctcggaggaggaagaacatgctccagagtgcccttctccatttctcagggcccagaggagaaagagaaacatagctctggccccaacagagccagcaggaggtacggagggaagttcctgtaggtgacattcctttgagagacattatggttgtggatggggccaggggacagaagatcccccacctcctaccttctggagtcacttgctattctctgttgaatgcgattccttattatatcatctattcaaggaaaactgaggttgcaaataatacatgaaaacacattttcttcatggttatagctgagtgggggtacccaaaatacatctcctgagctttagaagcatttcttcataaaacaatgcagacaatgcccagttctttctttctttcttttccagaatgaatgccctgggttcagtgatatctctttttgttttgagtgttcccttcctcattttttttttttttggttagcaggttcagatgtaggcaaacaactgatttcttctcacaagggaagctaaatattgttttaacatcagatgctaatagaatcgaaatccttttcagggtgttttgaaagtgtgattgtgaaagacaaaagaaccctggggatgggttaactcaaggttacgcccactggagagggggagcagagagcagagggtttcagggatccaatgagaaacaccaagagtcaaagctggggtctgtgacaattatgccacctgggccacaggccagatatttccttggatctctgcctgaaggaaatcttctcttaaaatagccattttaataccgatattatcctaagacaaaacccacttatcttctgcatattcaacgcctggcaatataacctctgtgcttttggttagaggttagcacctctgtgcccatctcaaatcttctttctgacttcttgctaatgccgtacctaaatgctaagttaccccgctgttgtccagcaaagctttgttctacttggcaaagaggagaggggcttttccacattctccctaattcctccccttttcccactgcctmctgccttgtttcgatttaaatcctttgggaacatggatcccaccttccacagactctttggagatcctacgccttgttcattgtccccctcttttaataaatctgttctgaaatgctcatrtaatcccaaatccccattttcagcgagcctttgccagggtttgactccagtctttcttcatgtattttccccctcctccaaaaaggtagcatgcagaaacccaagggtagtgccaggagaatggaaagtctgaaaagggcatggggcaagtcccagtttcactgtttaatttgtctatgactctccacagcacaggatacggccatgataaacaygagcaaactcaacagcaagctgcctggaggcccgtgacaaacggaaatggtgcttttgggatgcggctggatcttgaggagcactctgctctgtttggcggaagggagcttggagtggaatccacaccctctctccagtgcttggagtaaaggatcacgaagtcattatggaattagcagcttgcccagggacatactcaaccctctagtttctccaggtggtgtctagattccaggatacttcttttcagatccataaggtcaagagggctatagcttcctatgtaaattggttgaggtctcctagtctggggggatgaactcgggaaatggtataaccaggtggcctccatggatttggggatagcaccatctccaattctgtacctcctcaggtcctccccatgctgtctgtgtccttcctccttggccacaaatcacagccactaagagggaagtagatggtgaccaaaacagtcccgatcttgattggggcaacagttagttgccccaatgtaaaatgtaaaattgtaaaatgtaaaatgtaaaaatttgcatgtcaaaattcatagaactgtacaactaraaagagaacactctaccatatgtaaattatactccaattaaaaatagattaaaaagaaattacagcctcttcagaacactaatgaaagcctgattaaaaaaaaaaatggaaaaaaaagacacccaactgtgtaccaactccctcttcctccttctatatcatgaagtagtcaccatttgartggtaaaccttcctcccctgggccaggaacatggcctttgtgtgtcactgtgcacctgcaggtggatactgttgctctgccctctccacacagtcatgcagccttccctgggccrctgtgggctggaagtgggagagccggaactcagtcctggtttgtgtgcctctcaatttgttctttctccccatctacgacacgttcacactgggtgagtgctgacctttggcagccccactctttaggcagagccccagaaatccagtcatttcaagtgctatgttacggcaggtggatgctcatggtgtcttttgacaataggaagccacatgtttttctttgtagaaagtcaatactcccattctaggcatttttttacataagttctcccccatttcagaaggtgcccccactgttaggcactaaagtcccttccttcacaggattgaggtccctgcctttcagttcatataaagttgatgaaagttggaaagaaggacatgatcatcctgccaacccctccctgaaaagcagaggcatgttaagcctcaatttcacaaggaccccaaagcttttgataggcttctcttactaggcagacccaagcccctcattagagcctgccaccactgacccctggctcttaggacacagccctcatccttgaggtggcatagaaggsattaggctcctgctcatgtgcctgccagtgcctcacacgcccctgtggtctgtgttttggtcacattgagcccttcagtgcctcccactgcaagctctttgcacatgctgttccctctgcttagagcttacaggaacaccttgtgccccgccccttcctttcctagttaatgcctaggtacgcttcagaggaggtcatctccagccactttcctggggaaagcctgctctgagtcatgggcaacttcttttatcatcatctcttagaaagtacattcctttcctgcacagtgcttatttaggtttagaactgtactctcatttctgtgcttatttgattaatgcctgtcttttgccactaacctccaagctccatgaaggcagaagctgcctttgtagactcatcgttttgtctggaaacctgttgcaccacccgagagaagcactcagcgaactgtccacatgtatacccccatgcatgctagtcagcaagacagtttccagggtgtgctgctggctgatggtgtacaccatggtggagctgtctcagaaaacacagccctaggattctaacatttgtccttaaggaatctgaggctatgctgtc

SEQ ID NO: 13210 - DNA, 13083 bp, Homo sapiens
ttagaagtagtggcatactgtatgttgtcttttatgtctgacttcttccacctatgtcatgcttttgaggctcattcatatggcacatgtaccaattttgtattcctttttattgcttaatagtaatttattgtatggatatactatattttgtctgtctagtcatcatctgatggacattaagttgtttgcatttttagcaattatgaataatgcttctataaatattcactttcaagtctttgtgtggacatatgtttcttctagggtagacatttaggggagaaattgctagatcatatggtaaatttatgtttaacttttaaacaaacttcccattttccataatggcagtactgcgatagtactttgaagctgcctactgcatctcctttaagaatatagaagtattgtgctaggtgctggcatataaagatgaacaagtcagtttctgcccataagcattatacagtctaatagccaaaataattatagatataattacaaagttgaggaaatgaagtcgcttccttttctgtctaactagtagagtctactggggttttacataattaagattgtctgaaaccaaawcagagaaagctaaaggcttcttcctttcagacacgtattaagtacttgatatatttctgacagaaatcagagctaaagatggccttctgccagaagttgagttcagctgcatgaaacagaaaatcccacataatgagagcttaaagaaataaaggattatttttctgtgatacaacttgaaacctaaaggtaagcaattcagggctgggactacctctctctaaagtcatctgagattcagaagtctttyaggtttgggctccacattcacaggatcaggcccttgtcttcacacttataaaatgagggatagagctccagcctttacatcatcattccaggcagtaaaaaggagaaacagtcaagagcagaagagtttgtgcmtgttgaagtttgctggctgggttacttgaattgcctccctggaacttccatagaagacttcccttacatcactgtcaagtaktggatcatgtagctacctggtcttcaagggaggctggcacattagtattgcagctggacatgctcttgccccagtaaagcaggagtccattggtgaggaagaagagaataggtattgtgtggacaacccacagccctgacttctaggagtaagtaatcamgcaagggaaagagtatgccaaagaagcctggtgcacaggaggtcttctgtagtccttaatttggaccctattcccctaaagctgaacttgtgacagagacttgggagcatgtaatttatttgagaggtgatcctgggaaacaggtctgagggcttagagagaatgagatggatacggagcaaaagccaattataagacacattatcaagcagttgcagtaggtgatggaggttcaggggatatctgggaagcatacacagcatctgccattgtccacctgcaggatgggggagctgaagaatgtatctattgcctctggccctcattagttgagcgttgcccctggggkcatttactcccccctcatttccaggttgaactttgtcagatgaggaatgccacacacacacacaccagggaagactctggggcagaatgtgttcgtcacccttaaagtggcaccctggcagtgtaagttgaatctgagctcccacggaactgggggagctgtccagcaaacggctgttgaaatcagaggtaagctgggtgcagggacacaggcatcagcagcatctgcccctcatgaaaagttcatatttataataaaatctaatcgttgtgttctaacatgactgctggccaaactgtcccccttttcgtggcatggatgtgacctctaattatgcaatattctgcatgtcatttttaaaacagctttgttgagatagcgtcaatataccatacaattcacctaaagtggacaattcaatggwtttttagtgtattttagtattttcactaatgactaatcatattgagtcttttttcatgtgcttgttggacatgtgatatcttcctcggtgaaatgtctattcaaatcctttgcttccaatcattaaattgggcaatatgtctttttgttataatattaaattgtaaatgttctctatgtattccagatacatgtcccttatcagatatctgatttgtaattactttctcccattctttgtgttgtcttctcatttttgtggcatcttttaaaacacaaaagttgttaattttgaggaagtccaatttacttttttttttttttttttgagacagtgtctcgttcrctctgttgcccaggctggagtgcagtggtgcaatctcagctcactacaacctctgatacctgggttcaagcaattctcttgtctcagccactcgagtagctgggattataggcgtgcaccaccacacctggctaatttttgtattattagtagaggagacagggttttgccatgttggccaggctggtcttaaactcctgacctcaggtgatccacctgcctcagcctcccaaagtgctaggattacaggcatgagccaccatgcctggcccactttttttttctcttgttgcttgtgcttttgagagtggggaaggagtactgaaccctgtcagcttgtcagcaaggagaaagggtggtaaattagtgtatgaaatttaagaaaagctgtaaaaaatagttgacatttaagctggatcttgaagaataaggagggtataccagtcacaaaattgaggaagagcttttcaggcaaagagaccacctgggttcattatctcctaraataagaatctccttgttacatttattataactgattcaaaacagacacccccacatatgccaacaacatacggtaaacactgacagagactgtcatgtcctacaattgttattaataaagccaattcattcatgcaagattcagttaaaacgtaatgctrcatctgtgcaactcccccaggaaagtgggaagtagtgtttggagaagaccaaataaacactcatgagtgatgatgatacctctgaggacacagattttaagtactaggtcccagctgctctctttgaaggatgcacacgaccagagaatgaaagcaggaaaaggtggtcagtgctcagcacgtgccaagcacagagcaggaaaagacctagtagataatgaatggtccctgccttatagtctagctttacatgtatgactcatgcccttgaaaccacagactggatgtgaccctgagggtaagagaagttcccaaaaggattaagaatgtgtttttttccaacctagaagaatggtggcttggcmtcagaaattaagtcgttctgttgaaaataaacagaagtggaaatgtatattcagggcaacttaaactcatgctcttgacaaaatatttttttaaaaaaagcaaataaacaaaagtatttctcatgcccctcagttcatagacagaaactcataccaacaggctttttttttattttagtaagaactgccaaawggtgaaactattcacaaacactagaaatgcatgagagtgtcctcccgatattcttacctgaattttgcrtctttttatctcttgtcaatctagctgggaaaacgatattaaaatctcattttgactggcatttccccaacttcctagatggcttcacatcttttcatgtttattaaccatttgcatcttctcttcagtaaattattatttatatcctttgcccaattttcttaggggtaatttatctttttctarttaatgtgaaagtagtctttgtatgtaagagatagtaactttacctatagcaaatattttcattctgtttttcttttaacttagttcagggtgtttttccatactaaattttggattgctcatcttgcttaagatctttccaycccaaggatcctaagttttcttctatttccatatgcatatttttaatatttctcacacctacacacacatacatagttacatggagagatggatcattaattcacctagaatgtgytgtgtgtgtgtgtgtgtgtgtgtgtgtgtgtgtgtagggatgagaagactcagtgttttctgagttcatatgatctacatggggaatcagatctaacatggaccaagtgttaaaccatacttccaagaacaacactacattagtaggccacctgctaacttctgcctttcacattttccagcttaaaacatctccatcctccccattatgtaagaaagaagtacargtgtttctgactgctccctctcccatgatcccataacccatcagttctgaagctgcattatccaaccttctgaatctctctgaccaccctccaagtcttccaagtccccatggccactcccttgctccaggccaccatcatctcaccctgggtctttgcaacaccctctgccccggactccctggcctacatgctcagtctgtctaattcattctccaccctgcaaccaggaatatttctaaaatgcagaccccatctcattcctgccctacctatgtttcttccacagtccccattgctgtcaaggtactgtccaaattctcacatctggctgaggctgtccttcaggattcargcacctctcaactttttaagaaactgtgcagcctcatttctcagattgtgtctcctatttccatgctctgaccagagcagactactttcagcactttcaaaagcccaagattctttttcagtggagctcaactgtgactatgccccagctcacctgtcaaaaattgcaaacacacttgttcaggtcttacacctgggtgattctgactccgcgggtcaaatgggatctccacatccacaatctgtgatgacttctatggccagggtgctctctgcctccaggctgcagacgtgtgattccctctgcctggagtcctcttctacctcctccagctccagcccccaccccaccacccaccccaaactggatatgacctcttcctccttgaagtcaaagcataggtgctscttcctccaggaactttgacagtccgggttagggctcttcctctttgcatccctggtttcctggactttcctgattcaagcatttattgattcctcttcttccaccccagactctgagttcggggaagcctgagayagtggctgttgtcttgctcaccactgtatttcctgcactcagcagagacctgacacatagtaggcgctcaataaatgtttgctaaacaacaacaacaaatgaatgaactaacaaataaacaaacaaatgaacagatgagtggatgcctgtggcagtttccatgacaaacacaaagggctaagccaagccagcaagcagacagccgtgcggcctgcagagggcactagtctgcttcttaatctccctgcagaatcctcagggccaggtacctgctgtcagtcagagaggtgcccgatgctcagtggtcattctgctgcgctgaagattaagtaggagttgtttgcccttggccaatatgaaaaacctgagtgttctcccttcacttctagcgacaagtaacacatyccctgtcttgccatgaaaagagctktaactgtagcagccggtggcaggttttctgttcccaggtggggaagtgaggagagacaaacagaggggtgagagggagacagaaggaagacagctggtaagagaccctatggtgtattttttctatgtaaacargataaaaactgctyctcctggaacagcaaagttctccstatgtctccaagctacraacttgcatgctagctactaactagctactctccctctctctctctcttcccccttcgctctttctctctgtgtgtatgtctctctctctctctgtctcttcctccaccctctctcactatctgtctctctaccctccccatccttttattctagaggagaataaactctaagkccagattgaatgagcatccaaaagamgtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgagrttttcctgtctctgggcatcgtcagtckgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccawcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcytctttgcgcggctgcacgtcaagmgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggataggatgcagggccatggaaatgatcatcagtcgggtcacttttgacyytccatccacgtgaggtgtttagaaagaaaaatatatatacttagaaaatataaaaatgtgttaacagccatgattgtacttgtcgtttgtttttaagtttacaaagccttttaaaggggaaaattggtgaacaacagattctctgaaaggattccaagatgggtaagtcacaaactctgatttcccaaatagtcactgggagaaatcagcgaaggcttctctgcatgctctctgcactcatttccaaacrcccagggtgtgcgacgcctgtctgctcatctgctccacacccacgtcttcatgctccaggccagaccagactgaaggattctcatgaacaataagggtggttcagatctcttgcaagcaaacctgttacagctacgacctcctgctgccagctacacggagagatagctttgcacttataactccgtaggagactgagttctactctattattctatttacagttagacaattgtctctttgtgaaaggagcaatgctatgccgttttccccttttcttacccccatatcccttcagttgtccccacccccaaaggtagcatgaggatgtaacccacttctatttttctgttgttgtgttggtgtgtgttgttgttttgtttttatggattaaatctaagacaaccttcaaaactctaacgaaasagagaaagtgctttggacaatcagaatatacttgtgtacgtgtattttgataccttgctattttaaggtatagattaatctttttaaaataacttctttttttctatcatttacttttagcctttaaaacaagaaaggaaatcatgggttggggtacatgtatatacgtgtgtgtgtgtgtgtgtgtgtgtgtgtktgtatcacaagaaattgctttactgtagcttaagatagtttgagaaaccgtagaaccactgtgtgactttcttgggagcccttgtttttgcttatagtaattgcatctctatcacaggacttcttcaatattatctatgaaagagaaagtttttttgttcttttccctttttgcttggcattgtgttaaagttgagtgaccctgttatcaatgtctatatcctatcaagtacaggaattcattcctgggagcaaagggtgagactggctgactagtgctcgcattstcagatccttttctgcccaagataacttcaatttgtgctttctggctgtccccatatctccccctgtcacaaattcttatattaagctgtgtcttggggtgcaattgtgtgtttatcttgcactagcatatactggggttctttaatacttgaagattttctgctaatataagcaaaaccattcctttcttgctttggttatgatgtttggaaataataaaaagcttttatggctgctaaacgtgtgttacattgaaatacaccctggaatcattctggtgactcctgcacasggccatggtatgtttcactgcaattcagtgatgactttgtaagtggcataaacagctccattgatcacagtgctagtcttttctagggcaatgccttttagccaaactacaaaactctcccatttagtttccaaaaataccaggtttgtggttcccgggccactgtcgttctccattattttaatcaagacactaaattacaggactttccatggccgctcagtgggtaaatgtagagaatggggaatctaattacttgaaastgatatgaatagctatagggattatgtcttttttctatgtaaacaagataaaaataacttacttttcactcttatatcagttttcacactatttcattttatcccrttagcaaacctctaaaataggtgagtcattttacaaatgaagaaatttakcctyggaggggtgatatggttgtccaggagcacccacctarttagggtcatggtatattctgcatcctggggctgatgtccttttgcaccaatatgctgctgccagcaggttttcatcatcaaaactagtccccctctcctccctgtatgttttagcttgcaggggcacttccaaactggaaggcccacgagcatcacctgggatcctgtgcaagtgcagaatctgattcggcaggtccaaggtagggactaagagtctgcatttctaactccgacaagctcctcggggacgtggctgctggttgggggtccccatcttaaagagcaagggcatagaggattttcaaatgagtattatgcgaagtaaaagtactcttctgcytagaatgctgaccccacgccagggactgtgctaagcacttcacaggcatttgctcyttgtgataaccctaccaggtagataccatggttatcctgattttgcagatgagctatgtgaaactcrgagaggttaaggagcttgtctataggaactcggccakcaagtagagatagggagattcaggctggccagcccccacccccaaatccaaccagtgtcctagcccctctcatgatgacacaggaacctttgaactgggacccaatgacttgggagccacgtgtcgccatgcagagagaacttgatgcatgtttctaccacacacaggtccagatgttcccagcagagtttccagagagatgtcataaaaatcaaaaggcacaattaattctttaacttgctataaattttccaaagtctgtgagtagccctggggagtgcatcaaagaggtaagttactaaagcatccgtttccctagtgaacaaccctgaacgctggggtgccactgtctcctccgcgaccactttctcagattctcaagtgggaactcaccagatgttttaagcggcaggacagtcatgtttgaaaatgctwaattgttggaagtaaaagcacaccatgattttagctcatctgttaattcatttatcgattttcacccccatccccaaggcagaatccctgcagtacttgattctctgagtcytgagaagttgttgcctgttgtccttatttaagatgaacttttgaatttaattttgaaatctttctatagaggctgggtgctaaaacatacgctagcctctctggctgaawacattttttaattcacgctcacctccactaaaatccattctccacatagcagctagtgcaattatttaaaaatataaatcagattatattacacttctgctcaaaactcttcagtgtctcccattaccttttgaataaaagcccagttccttacccagccctgctaaactctagtcatctgatctcttctgctaactctccagcctccccttacaccatgcctctgccccgccccaaaccagactcgcatttgccatatgctcctctctgccccagggcctttgcaaccactgytccccytgcctcgggtctctacctcagatcttcctggcacakgctccttcttatcagcctccagcccaaatcctcagagatgccttccctgactgckctctctaaaggaggacctcagtcactcacaccatcactgttttatcacagctcttattactattttatattttcttgttaatttatttgattaattctcatcaatctctctcaccagaaagtagtgcctaggagataaaaatagtcaataaaaatatgtgactttattaacacatttaaatatgagctcaaatctaaccaaagagaatatagcacactggagattctcaaattttggtgactgtcagcaccatgtgaagtttgagaaagacagcctgttccctgaatctcatgatccaatagatcagaggtcatctccagatatctgaaaattttaaaatccacaggtgattttccgagtttggtatacacggtgtatgatgtacaccaaactcagaaaaccaccaaaaccaacaagttctgattattatccttaaagaataacaaaaatcaacacctcaggagcttacatgtctgccctatcaccccttcctgtcatcctttcaggtcggggtgtcacctaccttaaattaatgttggatcatccaaaaaccaaggcaaatctagaaacttggaagaaccagataacgaaatgcagaatacaagataaacccttcaatcagagaactcaacctttcatatctaagagcatttatttaggagccaaatcaacaaaaataataacaaaagacatgatatggtgtttattatgtggctgatactttactaagcacctaggtatattaacttatttaatcctcgccaaaaccccgtaaggcaggcacttttacctcttgtcctatagataaggaatctgtggatcacagacgtgaatcatcttgactgtcttgaccgatactactcagcagggatgaggcagagctgagatgattggaaaatgaccactaacgctacaggcttmaagaagcacttacacattgaatccacttttctttaatcatcagagatgtggataaaaaccaacacacaaggayacccaaggcggtagtgccagcaagggaaaaaaaggctttggaggaggagccaggcagcgctgggtgtgcatccytaggcaagtctcttgacctctgggcacctcattggcttatctgcaaggtgggagctccacctacttacatggcagcaagcagctgtgatgattcagtgaagtataacaatgtccaaaaataattagcacgtgaacttcacgtcccctttccccttcrcttgctggactctagacatttctgaagttgcctgcagttttcctgcccctcgtctctgaggttcctgaaaacagcagttattaatgaggggaaggagaggagaaggtgaaagtttagcctaatgtttctacaagtacaaagtgaattccacgggaggcatacaagatggtttgtgatgagtacacatatcaacacgtgcccacttttttttcacagaataactttccaagtaaacaacaatttgaatattttaaagtgtattaacataatatgtatgtctgaatgtatattatattgtttataaaactcatgatttttaaaatagtattgctaaacatgagacttgagtggtacctgcaaagaaagaagtgagttgactaggataaaattaaataaagccggcgatgtggctcacacctgtaatcccagcaccyyggaaggctgaggtgggtggattacctgaggccaggagttcgagaccagcctagccaacatggtgaaaccccgtctctactaaaaaacacaaaaacttgctgggtatggtggagcacgcctgtaatctcagcaccttgggaggctgaggtgggtggattacttgaggccaggagttcgagaccagcctagccaacatggtgaaaccctgtctctactaaaaaatacaaaaattagctgggcacggtggagcatgcytgtaatctcagctactcaggagactgaggcacaagaatcacttgaacccaggaggcagaggttgcagtgagtcaagatcgcaccactgcactccagcctgggcaatagagcaagactgtctccaaaggaaaaaaaaaattaaattaatgggatacaggcattttaaaattcagaataggaatgtttgaaaaattgaagtttgagaaaacctatgctcaaaataaaaccattagaggagagggggagtaaggcccagaaataaggcaggagaggagaggaagtcaagaataccactgagactgggscaagaaagaagctgccatccatgtgatgggtccacagagaaggatagatcgagtcaggattctcaagcagtttggctgtgcaattggcaygtattctctgaccccttggcattctctggagagaatgcactraatattttcactgcatttcacctgagtttctcagcctcaacatcactgacatttggaagcagctcattctctgttgtaggaggctgtcctgtgctgttagcatgtttagtagcatctccggcctctacccatgagatgccag

SEQ ID NO: 13211 - DNA, 12664 bp, Homo sapiens
agaatattaggattgtggggtttttcttctctattctccaaactttctgtaaagttgttaacatagtcttcaccaacaaactcgtgactaaacataagcatttatgcaaagtctcaggaagtttcacacaccccaggatgaagaaacgtggtttcaggagtgaagcaacagatgaaaaggcaggcgggggaggactaagtgactgaggggtgggatcatcagttcctcccaggcagaagagaagattcttatctagagaaactggatactctcagaaatctaaggacacaaatatctggggtcttcaataaaagcaccagacaactcccaataggaaagctctgtggtcaaacatgtcctattcatacaaacacagcttgtgatcagatgcttagggctccacattaggtacagacaaccagaggctaccagacatccagagaaagtctctatatgaaagagcggtaacaagaaagaaccccagaaaaaaagagaagcaatgcagggaacaaaaatctactttataaaagagctaaaaaaaaaaaaaaaaaaaaaaagcctttactattctcagggagtcagcagaagaaacaacattcataataccagggctagatgctgtaaagacagtaacaacaaacagatgaaaatgatcaaagagtgagctggggagagaagaggagacacacacacagctttctttcttttgagacagagttttgctctgtcacccaggctggagtgcagtggcgcgatctcggctcactgcaacctctgcctcccgggttcaagagattttcctgcctcagcctcctgagtagctgggattacaggtgcgcgccaccacgcccagctaatttttttggatttttartagaggcagggtttcaccatgttgaccaggctggtctcaaactcctgacctcaagkgacacttctgccttagcctccccaagtgctgagattacaggcatgagtcaccgtgcccggcccacacacacatttttaacagaaagaatggaagatgaagttaaaaatatctcccagaaagtaaaaacatagagatagaagatagattttgaggctcttttcaagcactccagtctctgcttaaggattccagaatgaagatttttaagttaaaaaagagacaattttccagaactgaaagacaaaaacctctatattaaaagggtccaatgagcaccaagaacaatgaatgaagactaacccttggcacctcaatggctaatttctaaaaaccaaggataaacttccagaaagaaaaaaaatattacatacttaagctacttacatggttatactccagtctttgacattcccaatatctgaaaacctttcatgatccaagtttgagcttcccattctttaactaacttcttctaccttcctgctcactcaatctagwactctaataactgttggaacttaccaggatctgtaattcactgaccccacamcttcatagggtcagtcttcctcctcaagttcttagttcctaattatatcactaatttcattgtgatcactccctggggtgttgtataacaatgctcctttgtccttycactatactaatgtgacaaaaccccaatctctgcaaatgccatgcctgcagctgggcaactgaatgtggctggagagtagcacaacgccatgctgactcttcccactttaaatccttggtcaccaacctcagggaagccttaaggctgcctggcaattctatwacatttctctagtccattcactctcctgcttatctggcaattattttaacctcctcacatctctaatacatctcctcatcgtagcagatcagtttgctttccattttactgaaaaaacagtttgcactcagaaaatttctacaagctcctactaccataaggatcccctcacctgcactgatgccggcaccctctgctttcctcctatttctttactttattttctttctttattttttgagacagagttttgctcttgttgcccaggctggactgcagtggtgcratctcggctcaccacaacctctgcctcctgggttcaagcaattcgcctgcctcagcttcctgagtagctgggattacaggggcacgccaccatgcccagataattttttgtatttttagtagagatgaggtttcaccatgttggccaggctggtctcgaactcctgatatcaggtgatccactcgcttcggcctcccgaagtgcagggattacaggcgtgatccaccacgcctggcttgctttcctcctatttctatggaagaactgtccatgttatccaaagaccaatgcctccaccatcccctcacctattccaaaatctcttcgacagcaccaatttcctcctttytatgagattatccccattagtagagaaatatgttgatattttgtccatcttctaaaaaataccttggcctaatgtctccctgtagctaccatcccacttatctgtgcctagaaagagctaccttgctgtctctaatttatactcaccgattctctcttgagctaatacattatattatatgtgtgagtactgcaaaatatttgaaagataagctagaacattttggccaattagcagtaacacataaaacctaagagtttatagaaaaagaaacaactattaattttagacaaagctttacaattatataagaaaataaatgatcatagccaaagctcaacaatacttacacagtcgtaatttaagtaaataagccaaatatatcactgcaatagaaaagctagggaaagaaatgtagatatggaagtgggaagtggaagtcaatgatgtttaaaatgataaatttggagaaagctattrgagtaacagaagaaagagcttaaaaaagttgggkcctttgagtaataatgctgaggaaaaagagggataagaaaagaaacttctgattgtcattagaactttttagtatatttgacttgttaagctatgtgcatgcattactttaggaaaataatttttaaacaataaataactccaataaagtacaaatgactgaaacaagtgagttctgtagttcgtgtgaggggaaaggtctctgggaggctatgaaaattagtggggggaaaataatgaacttgaaagaaaactgtggtgtaaaacaggcaatatttcacaccaaaataaccataagctatgaaaagttggtcaaaagcaagacagcagatgcaactaacatccccagattcatagtaaatatgggatagatgcttccaggacaatatggataatgggtagcattttcatttaagagctaaatcagatgaatttcacaactggtacatgtattttaaaaatatataaaatgagcattttgatatccatttctgattggttcatggtcatcctgtgggaagtctcatctaaactgaacttacaccataactaggctatttaaaggcttgatttaaaatggtcttcagagtgtacatattaatgtatcttgtttataattcttattccaacatgtttgttaaattaaaacaactttcttccaacgaacatatagtttttcatgagtatctttttttttttttttttttttttttgagacaaggtcttactctgttgccaggctggagtgtactggcatgatcttggctcactgcaacctccgcctcccgggttcaagtgattctcctgcctcagcctcccgagtagctgggactacaggcgcacaccaccatccccggctattttttgtatttttagtagagatgggattttgccrtgttggccaggctggtcccaaactcctgacctcaggtctcgatctcttgaccttgtgatctgcccaccttggcctcctaaagtgctggaattacaggcatgagccaccatgcccggccttcgtgagtatcttttatgttcacgacatccttgtgacttaaatgcatgatatagattgtccctactcccttctttcagaaaattcttttcacgatataattctacatctctgttcttaccccaaggatagcagttaaaactctcaacataatacacaataagcctttaacttatactgactcagaacaaattaagtccccaaatcatcaatgccactcttcccacaaccctctgggttttcttcagaggttttagttcttcaataggcaagatacatcacgttcccatcacagggcaagagaacgctgacaaaaataaagatcttagctgagaaaagtactaagtagctgggtgtggtggctcatgcctgtaatcccagcacctggggaggccaaggcgggcggatcatctgaggtcgggagttcaagaccagcctgaccaacatggagaaactctgtctttactaaaaatacaaaattagctgggcatggtggcacatgcctgtaatcccagctactagggaggctgaggcaggggaatcgcttgaacctgggaggtggaggttgcggtgagctgagattgagccattgcactccagcctgggcaacaagagcaaaagtccatctttaaaaaaaaaaaaaaagaaagaaaagaaaagtactaagtaataaaaatacaccaattcacagaccagaccagaggctttaggtttctttctactaggaatattatactgttatataaaatcagttttctagttaacaattcacttaattctttaccacacgatccagtaatgtcactcctagagaaattaaaacttatgttcacagaaaaacctgtacaggagttctattcataattgccaaacactggaaactattcaaatgtccttcagtgggggagctaataccaactgtagcacagccatacaacagaatacttctcagcaacaaaaaggaacaaactgtcaatatatgcaacagcctgaatcaatctcaaagacatgatgctgagtgagaagaagccagtttcaaaaggttacataccatatgatcccattttatttgacattctcaaaaaaagacaactgaccaggcgtggtggctcacgcctgtaatctcagcactttgggaggccgaggcaggcggactgcttaagctcaggagttcaagaccagcctgggcaatatggtgaaactccatctctaccaaaaataaaataaaataaaataawtaaataaaataaaataaaataaaataagccaggtgcggtactgtgtgcttgtggtcccagctactggggaggctgaagtgggaggttgcttgagtccaaaaggtggagcttgcagtgagccragatcgcgctgcactccagcctgggcgacagagccagactctgtctcaaaaaaaaaaaaaaagcatgctattaaaaaacaatataaacttaattttcgacattccaaatgagagatcaaaagtttcccaaatgcaagaagttatatgattattgccttcttgaggaaaaaaawgttccatttacattagcaacaaaaattataaaatagcttgaaatgaatttaacaagcattatataaaacatagatgraaaaagttacaaaacctgaaaacaaatttgagacacatgcacattcctgaatagaaacatttggcattagccggatgtggtggcttacactggtaatcccagcactttgggaggccgaggcgggtggatcacctgaggttgggagtttgagaccagtctgaccaacatggagaaacccgtctctactaaaaatacaaaaattagccgggcatggtggtgcatgcctgtaatcccagctactcgggaggctgaggtgggagaattgcttgaacccaggaggcggaggttgtggtgagctgagatcacgccactgcactctagcctgggcaacaagagcgaaattccgtctcaaaaaaaaaaaagaaagaaaaaaaagaaagaaagacttggcrtcattaaaatatcaatttcctcccaaactattaataatttataaaaccaactaaaccctcttttctggttagcgtggcatgagaacccataagcagcaaagtctctcacgacaccctggatgaggcggtgcaggaagtcctgcacgggaaccagygaaagtgycccaagttcctgaagatggtggagttgcagatcagcttgaagaactatgacccccagaaggacaagcgcttctcrggcaccgtcaggcttaagtccactccctgtcccaagtgtgggtcctgggggaacagcagcactgtgrcgagaccaaggccacggatatccccccaagtggacactgaggtgccaaaaaaactcaagaataagaatctggtcaagaagctggccaagaagtatgatgcatttttgscttcagagtctctgataaagcaaatcccacgaatcctcggcataggcctaacaaaggcagtaaagttcccttccctgctcacacacgatgaaaacacggtggccaaagtggatgaggcgaagtccacaatcaagtttcatatgaacatgttatgtttggctgtggctgttggccacgtgaagatgacagacgatgagcttgtgcataacattcacctggctgttaacttcttggtgtcactgctcgagaaamaactggcagaatgtccgggccttatatatcaagagcaccaygggcaagccccagcgcctatattaaggcatatttgaaaagattctactgctactagtaaaaaaaacaaaaaacaaaaaaccaactaatcccatgaaaactaatctaatcaaaatttcatgctctgtttttagaaaatggcaacttaattctaaaattcatgtggaagagtaaatgaccaaaaaaaaaaaaaagctatgaaaattttgaaaaataagagtcattggccgggcgtggtggctcacacctgtaatcccagcactttaggaggctgaggtgggcagttcatgggttcaagagatcgagaccatcctggccaacatgatgaaatcccmtctctactaaaaatacaaaaattagctgggcgtggtggcacacacctgtaatcccacttactcaggaggctgaggcaggcgaattgcttaaacccgggaggtggaggttgcagttagccgagatcccgccactgcactccagcctagcgacagagcgagactccatctcaccaaaaaaagagagagagaaaaaaaaaagaatcatcaggaggggaacttgacctaaaacatacaatccacagctgcagtaataaaaacaccacrgtatgggtataggacyaaataaacagactggagaaataacaggacacatatgagaatttattatgtgttaacgcaggtatcttcaattgttgggagagaactgatggttctgggacaattgtaatccaagtggaaaaaaaaagtcagatccctacacctaatactaatcttcccaaatacataccacatgaattaaacgttaaaatgtgagccataggaggagtattagaagaaaatacaaaactggttttttgtttgtttgtttgttttttcgagacggagtctcactctgtcacccaggctgcagtgcagtgatgcagtctcagctcactgcaagctccgtctccygggttcatgccattctcccgccttagcctcctgaacagctggggctacaggcgcccgccaccatgcccagctaattttttgtatttttagtagagacagggtttcaccgtgttatccaggatggtctcgatctcctgacctygtgatccacccacctcggcctcccaaagtgctgggattacaggcgtgagccactgcacccggcctatagaactgttttttaagtcacgggacaaatcttcaagaagacatgaaacccaaatgtaataaagaaaaagattaaatgattttgccacataaatacttaaaaacttccctaaaacaagaaagacatcataaacagttaaaaggagtaatctagggaaagatattcataacctacattaacagacacatcagacagatgactgaaacataaagggtttaaatcactaagattaaaaaaaaagaaaaatgaataaaggatataaacaggaaacttgttttatttttatttattttagagagtgtcctctgttgccccggctggagtacagcggtacaatcatagcacaatgcagtcttgtactcctgggctcaagtgatcctccttgccttggcctcccaaagcrctatgaatacaggcatgagctactgcgggtggccagggaacttgcctcaaaaagaaattatgaatgacaaaaatatataaaaagatcataaatctaagtagtgaaaagggaaaaagcaacttctggttttytctacaccctttttttgtccatacgtgctatggtttgaatgaatgtcccctcccaaactcatggtgaaacgtaattgctgttgcagcagtactaaggcatggggccctggagaggcaatcagattgcaagggctctgccctcttttcttcctttctcctcctcttcccttccttccccactctttgcccttccatcacgcccttcatgtatcaagaaggccctggccagatgcagcccctggatcttggacttcccagcctccacaattgtaagaaataaatttcttatctttataaattacctagtccctggtattgtgttacagcagcaaaaacagaytgagaccttcagatagacaaaaattatctacagtgtagaagcatgtacgaaaatgaacactctattccattttggtagaataataaagtaggtacatcactttttattcaaaaccaatttagtagtatctattacaatgtcaaatagtcatccactttcacccaggacttccatttctaggaattatcctacagaaacacttaacaaggacacgcaatgctaaagaatgtccactgcagatctgtttgtaacaacaaaaatttagaaacaaccctaatgcccactgataggaaataaactatggtaccaccatagccaggaagactatgctgcctttagactaatatgtcagatctatgagtactaagacccagacatggtcaaggtacattactaagtaaaaaaactgtcatcatgttccatgagtccctttctgttaaaattttttaaaagttaatgtctatataaaaaactctgggaatatacaccaaactgctgaaagtgattgtctttgaagagacaaatttcaaggaacttactttytacataatgaatttctatatttctataatgtttacattttatatgtcatatctacaataggcaaaaaaaaccccacaagagtaaaatgattttgttcaaagwttttccttttttttttttttttttttttttactttaagttctgggatacatgtgcagaacgtgcaggttaaacaggtatacatgtgccatggtggtttgctgcgcccatcgacccatcagctacattaggtgtttctcctaatgctatccctccccttgcccctcaccccgacaggccctggtgtgtgatgttcccctccctgtgtccatgtgttctcattgttcaactcccacttacgagtgagaacttgttcaaagttttaaaaaaactgagaaactgagaaagtttttaaattaaaccactctgctagtcatattcaagcatttctagagaaagaacctactagaagtaaacaccacaggccagactctagataatgtaaatcaggtaaggtaaatggaagaggttcgtctgtctcaacgctctcttggcccaccatctctgcccacatgaggaagctggcaagtagccacctggaactggtgggaactaagaaactcagaggtctcaccgttccttatctcaagaaagctttaatcaaggacaacaaggacagctccgcccacacaagctgtttacagattccaaaagcagtctataaggcagctcagcaacaaggagtcttaactaaaaatccacaagaattttatcactaaaattaatgaattgtcaaaaggcaaatttctggcaacagtcttttaaaattccagttagcacagtccagtgcttcccaaccttttccaagtctccgcacacacaggaaatgaaaatatttacagggcacaytgctgcaaacagaggatgcatgctgacagatgacagacccagggctcatgctcttgcagccccaggcctggtgggctgcaggcatgaatgctacgccatatgtgtcacagtcttggcacatctatcagaagggtctcgcacagggagagcatttgttttaaaagcttccttcaaaagtattactacattcaggccaggcatggtggctcacgcctgtaatcccagcactctgggaggctgaggtgggtggatcacctgacatcaggagttcgagaccagcctggccaacatggtgaaaccccctctctactaaaaatacaaaaaattcgctgggtgcggtggcgtgtgcctgtaatcccagctactcgggaggctaaggcaggagaatcgcttgaacccaggaggcgggaggttgcagtgagctgagatcacgccactgcactccagcctgggcaacagtgagactctgttgccaacaccacctcccccccgccaaaaaacagtattattgcattcatttagcaaatatttattaagtacctaacaggttccaagcactgtgttaagttctgtcatcttcccctacagactggagayagcctacaaactagagaaggagacagacaaacgagcaattccaatacaatgtaaattgtgccatataaggggagtatcgggatttttatggaatcccatgcctggggaaaggggatttgtcaatgattacttctcagaaatgttccctaaacagaagagtaaagagtatttcaggtacagggaaaagcaggcgcaaagacctaartgcaagaaactacatcaaaggttgggcacgctggcttacacctgcaatcccagcattttgggaggttgaggcgggcagatcaccaggtcaagagattgagaccatcctggccaacatggtgaaaccccatctctactaaaaatacaraaattagcygggcatggtggcgcacgcctatagtcccagctactcaggaggctgaggcaggagaattgcttgaacccaggaggcggaggttacagggagctgagatcacaccactgcactccagcctggcgacagagctagactccgtctcaaaaaaaaaaaaaaaaaaaaaaaaaagaggcaaaacaggctctgtaccatatgagtataacaagaggagggagttagttttgtggttttaatgcatgtatttttgattaataggaacggggctgagcagaaagccatttcacaaaggttaggaaagtatgtgccttcctacacaataaccgattaaacatacgctatgagaaaagtagagagattaagaaacttcttgaagataaatctgtaaatattgacaataatattgattagcaagtaacatgagctcatacacataagtgtatacctgaagttaaagacaatttttactgtggtagcagacatttgctactgaaaaagaacaaaacattacctatttttaaaggtaaagactatttaaacactctatgatatttccaacgtttaaagtaatgggaaagcaaaagaactcccagatgggccaggcgtggtggctcacgcctgtaatcccagcactgtgggaggctgaggcaggcggatcacgagatragatcgagaccatcctggctaacacagtgaaaccccgtctctactaaaaatacaaaaaattagccgggtgyrgtggtggatgcctgtagtcccagctactcgggaggctgaggcaggagaatggcgtgaacccagaaggcggagcttgcagtgagccgagattgcaccactgcactccagcctgggtgacagagtgagactctgcctcataaaaaaaacaaaaacaaaaacaaaacaaaaaactcccaaacacctaatatatgtttcatgttcttttgagaaagcttaattaggctgggcgtggtggctcatgcctataatcccagctactcaggaggctgaggcaggagaatggcttgaacccagaaggcggagcttgcagtgagccgagattgcaccactgcactccagcctgggtgacagagtgagactctgcctcagaaaawaaacaaaaacaaaaacaaaacaaaaaactcccagacacctaatatatgtttcatgttcttttgagaaagcttaattaggctgggcgtggtggctcatgcctataatcccagcactttgggaggctgaggcgggcagatcacctgaggtcaggagtttgaaaccagcctgactaacatggtgaaaccccacctctactaaaaatacaaaaaaaaaaaaaaataattagccaggcgtggtggtgtgcgcctgtaatctcagctactcaggaggctgaggcaagagaaacgcttgaacctgggaggcggaggttgcagagagccgagaccatgccacttcactccaggcctgggctacagggcaagactccgtcccaacccccgacacccccctaacccccmaaaaaagaaaaagcttaattagtgaggcatggtggctcatgcctgtaatcccaacactctgggaggttgaggcaggaggactgcttgaacacaggagttcaagaccagcctgggcaacac

SEQ ID NO: 13212 - DNA, 27852 bp, Homo sapiens
  misc_feature (1)...(27852): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctcaccctgcaggcttttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaargaagagaactgttcctatgtgtgaggtcagttcctrwgtgtgagggtttcgagaycagycagtgtccctagattctctgacaagggggagaactatgaatcttcaggaaccccyaagccaaggtcaggaagtctccattkccctggcttcaaactatgctcaggagctggtatagaagaaagatggggtttggacatggccccagggtatagatgcagaagataagatgagtggaccccagagccagagagtcccctgctcttcagaggtggggtctagabggtcatcagagactcactccactccacggtgacaggactrtccakgctggtgtgctccacttggcagrtgtagacrtctccctgctggggggtcatttccagcatcwccaggatctggaaggtccagtctccattacggatcaggttggtggacacgaccccagctgtttcctcctgtccattcaggaascatcggacttgaatgctgyctgggtagaaatcygtcacgtggyagacaagcaggttgtggtgctgcargggcyccttcttggagggggaaacrttcaccytaggctggactasgagygkggaagraaaataatgaaatagmatttgagattgtccttctttccttccttccttccttccttccttccttccttccttccttccttccttttttttgagacrtaatctcgctctttctttctttcattctttctttttgttgagrtggagtgtcrctctgttgccaagtctggaatgcagtggcgcaatattggctcactgcaacctccacctchgggsttcaascaattctccttcctcagcctcccgaatagctgggattataggtgcctgccacytcacctggctaatttttgtattatyagtagagacaaggtttctccatgttggtcagsctggttctctaggagcacttgaccaackcctgacctcaagtgatccacccgctcrgcctctcawagkgctgggattacrggcctgagccactgcatctgcccagattattatttcttaggcatgttcactaygtaattgattcctagatgttgaaaatagrwataatgtgattaggctagtgggtaagggtagcaytgaaaagatagaaatagaccttcaagtagagcatgcatgatcttgaataaaataatarttagtaagtatatagcggaatggcagggagacagagtttgcactctgtagcacatwtaggagaaattttaaccaaaagtaatttgggcaaagaatatttratcaactgtgaaattacctrycttttcaaagttctatcttgatacaaaggawgcaaaawttactcaaataatatcttgaaattaagatatacagacaatggcattatggtggcctgtkaatctaataayttcatgaaaatacaaagaaaatgaagagagcttkacatgtcttattctgtaaawaacctakgtatttttttacctcacytacaaaaactcaaaatcttcatatttacakaatatcctgagcycctacatgcttgagtagtagaaatcccrtccttttycaagttcctcctmwgtgmtgygtcttcaggtcccatgaaggtctcacagatraccagrtgttgcctccctctgcatctttgcatttgtgccccagcttgtyctgttgttctcaggtsaatttccacactgccactggcaacttttcttttggatctctgccaccagtacctttttcctyctcrgaargcagaaaaggccaggcatggtggtcatgcctataatcttagcactttgggaggytgaggcrtgaggatcacttgagcccagggtttygagaccrgcctgggcaacatagtgagaacccatctctaaaaagaaaaataaattagccagacatggtggtacrtgtatctgtagttctagctacatgggaggctgaggcaggaggatcacttgagcccaggaggttgaggctgcagtgagycatgatggygccacagcactccagcctgggagacaragygagaacctgtctcaaaaacaaacacaaacacaaaacaaaaaacaaacacagaaaagggtcaagtgctcctagagaacagttcattcagggagatccactagagaacagctctttcagaggactaccctagagaacagytcatcaagaggaatgtctcaaattagtcttctaggtccctaatcactcagttctttcctttctacttcctggagaacacaaatacccyaacatggcgctgggccaggtaaaagtacagtcttgaactgacacacaacccttactccctattgtatttttgccttgtttwcagactgatccacattgtcagcctcttccctcaatgtgagtttatttcaggggcacctgtgtctcactacttcattacctcggttaactcaaygtccattacactattcaacttatgtctaaatctcagttgtgaattacstacaatttcttccccatagagcttctgggaaccatgaaatcagggggaatacttgggtatctgttttaaggtcccagaacattccaygagaggcatcttgctcaatattctttgacaggagcaggtcagcctggagccacatcagygacctccagggkgcgctggagttaaggcytgatacccaatggcctcatttctgacccagttcaaatacatttcaccaaggcaaggattcctgtttgttctagttgccttctctaatgcccagaaaacatttgctcaattacttctagatttgggtgrrcatmcaccctggaattgtcactactyctttcctcccccttccacctctcccytgcctctgtsttttccctgttctaactcatkycttgattgcaatttccctgacaaataatagcagtttcctacctcatytccctgcctctggtccctcctctasccagcacccttagtagtcttctgaagacacatctccaaccttckctttttcatttttcaaaaatcttcagtgttctgacaatacttatcyggctacatgggaacctctagggagctgattacaagcagagatccccmgacctcccyacccagggaatctgagtctsggggcastgagtctggrkatctgygcatcacagakgatctccagragagtcttcrgagragtgaggttggggacctgygggcctrgaggagaaacycacactccttaggctggyatcarggctsyctgcaatctggcagttgattactgtgaaagaaratgctgccrtgtcactgattkgtgcctctacaaagtcttagtaacagtttttgccaattgcrttayttttatttgaacacctctctcaaccaattacctcagcaactttcctaagctcatgtcactcacctcatccccacccagtgtgtccaccttctcactcatagcaggtgaacttcctttcactttccaggaacaagaaaatcaaaggtgtgatctccccagcttcctcctcctcctcccttcatttttttcctctttctagaaaaaaggtccagggctcaatcccacatcctgatactactccctcargtcccwmaggttggtgcaccaggctccccaccccacaarttcacaggaggaagccaaagctccaaggccytcctgtcccatccttgagaaatcctcttactgcacacacctcacctctctccrtccctttacacccmgacttcctgaaggaaaaagaygaatgaactsagacactgccctgtgmcagccrtggggaacccaagacaagtaaaatccatctcagccccgaggaggatgcgccacactcagcctcatgcaccccctcccattccagctcctgccgctgcggccaacctgctctccccaggtctccctggtttccaaacccactttccatcttctgttttcygaccttcccaagtcactggcaccgctgtccactgtgctgctgaggtcacctcccctcagcttccaagactcttcyctgcgggcctctcctcacactgcacttgggttttwttggtctctttcacaggcttttctgtcttggccaaatcacaactgtccagttcccaggatccrgtcctttgctcttccccctgggtccyctctccctggatggtctcatgtatcycagtctcctccccggctgcagacccttctgtctacctgcccatcagaccacccatctgcccctcaagcacctcaaacccagctacctccctgtaggtttcttctctgtgtggcctgctgtgccatctccacctccatctccacaccatacccttgtgcgctgtcctgtggcttccttttttcaccccacatgcagtcagctgccaggcctgatgaagtcccsggggtctctctgctcycgtcctcctcactccatgctcagcccagtccaggtccccgcgctcgctcccctgacaagctccagatgggctccccccatgaatccccaacccaaagtcccctttccgcccggcactaaggtcccttaggccaacccggctgctcctgcgccctgggcacgggcccrcggggctgccctgggaccsccggcccaaagccctcactcacctcgrygctgyagggtcaysgscycghccagctcgtagttgtgtctgcayayyctgtccrgmamtgcmcrcyyctcctmcaggwdgtscttctggctgttccagtaswcckcvkcaggccgccccagctccgtcaccgcccggaactcycmcacgtcgctgtcgaagcgcrcrwrctcytscckgttgtagatgtmtctctccaggaagcgctgtgtcccattaaacgsgtagcattcctgcmgtmmctggwvmasktaattctctgcggggagggggcggacatgagcggaggcgccactctcatctaatcctctttctccctctctctctyaatattaasgattcttcccaaatctwcccacycagggctrgattttaaaataggagttttcctagtaycgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggctggaggaggcggagacgtttcacktggggtcactgggagaaaaaacaggggcrggaggagctggggacgtggagggcggagctsctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatktaggaratgtagaaatatatttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattsatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaagatttgttgcacatcagcagcactttcagctccttgaggctgtggrccagaaacttctggaagccactgggcagcatgtkttttttgttgttgttgttgctcccataagcaatgttgggcatcaagatctggcccttggaccttctacgaaccctactgttaagacctctgggtttccgccagttatgcttaattttgacatttcagtctgattggtgcctcatgaacttgttggtcctctttttgaggatcttatccttcatgaggagtctgagggaggccatgatgtggaggaagagatggctgccagctgcatagrcagcaccgaggaagacagcattgatgtaatttttacatgaacaattttggcagcctttcccacatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgctaaggcaagatcccaggtcttgactcagatatcctgacctgcctcttctcctggtgcsttgggcsccagaccctraaattccaggcccagrgcccccyagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataagaattttgaattttttctttgcaacatttaatttttttaatttacccagtcttaggtaattttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattcagaataggatatattaaaaacctctagctccctatgggttgtctcagccaagcttttctcccccagcctctttaagctatagcctggctcctcagccctttggtcttgtgccctgtttgaggttggggatgtgtgtggagttgggggagcatgcagggaattgtggaatcagccctgcccactttacccactcccctatggctccagctctccctccagcarrttttgattgaacattcattctacgcagggagctccagtaatctaccctcagtccctgtcacatggctccactgcctcatctcattccccctacaaacctcaacccagcctttgccygtcctccctttcactgyccagcatcacatgcycccttctgctctctgctcccccacctctgggtttccttggtgrctcccaacactgtccctcatcccacatgacagctctgcctatgggatggggrygcygcatccgtcacytcctcctgacactgttcagtgtcaccagtgctgctccagcctcctctctccccagcctcacccctctgcagttcccagggctgagccgtcctgctggttagttctcagcacccttctgtgactayaagttcaagttctcctccccttcctggacaatgaacccraggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttgaactagtttacagtcccaccaacagagtaaaagtgttcctatttctccacatcctctccagcacctgttgtttcctgactttttaatgatcgccattttaactggtgtgagatggtatctcaagacaktgtggcaattcctcaargatctagaactagaaataccatttgacccagccatcccattactggrtatatacccaaaggattataaatcatgctgctataaagacacatgcacacatrtgtttatwgcggcactattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaaycatcattcacagcaaactattgcaaggacaraaaaccaaagaccacatgttctcactcataggtgggaactgaacaatgagaacacatggacacaggaaggggaacatcatacaccggggcctgttgtggggtggggggaggggggagggatagcattaggaaatatacctaatgtaaatgacgagttaatgggtgcagcacaccaacatggcacatgtatacatatgtaacaaacctgcacgttgtgcacatgtaccctagaacttaaagtatatatatatataaaaagaaatatcctgagagtatcctgagagaaaaacaatggatcatagatgccataatattacaccagccacagggaggcagcaggaagaagagatttttcacttggttactgcttccttggctgtctgataacctacactcaatccctgtcatgcacccacacaacctcatctcattcttcctacaagtcgcaacccactctagtaccctaaccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctctgcctgagtcccctccaggctggatgcagayrtgaacacgcccaggagcctgcacttgccaacttctctctstgcaaaccttgtctgtccaaggttatccwggacctcttggtcccattttccccaaagacaagcactgaccactgggcacctctctctgtttactgtacccatgtccttggagagagaataggccagtagggtagcaagctatcctataggggatgaacctctttctctagctgggaagagaggacactgccttagggcaggagcccccgcagcctgtctcagaatttgatcccttaaagataacgtcccctaggaattgttccctgagcyagaccctccaagaatggcagytcggctcttacctggagtggccctgccctggaccacagatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattggacagagtctgagaaaagaaccaatggacactgagctttgtatgagtcattgctcactaggcagaaagttagtatgaaaggtctgaaaatataaagcctgtgatgcacttaagatgacggaggaaagacagtgatactcattttaaccagtcagataagtcatgatrtttggsgagattatgcgttttctttgctctgaaggtgatctcaaatattctgctggcccatctacagggattatcatttccccaattctgccacacctcacacacccacaggacatggtctgttgtggaaaaagtgctatcttagtgtgtaaaaggtcattcagtggcatgacttagagggattagagtacccatctcagaactcaaatgaggtctgagtctgtctgtcttgcctttgtccaagggtgtgtttaagattagcacccattcatatttactttctcccagaggtctgtgagtcctgcgatgtgcaggagttaccaggttcttccacaggactgtcatcagggtcaggagggctcagtctagggacsttacactgggagcgtggacacaccacctaccctaccatgtaaatatgcagctttaacgacactgcctctcttggacttcgattccttgtcttcaatatggggatgatataacctgccttatagcaaagctsttaagatcaaatgagatcaataggtctgaaattgctttggaaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttcaaaaaaaatcaaattggcatcatttctttaaatcaatattaaaatgtaaatagaaggctagcatgtaaaatgcaagagaagaaaataattatgtagtagaaggtgtctagtaggattaaggggccaggagaggattgtggagaaaaactcagtttttttagtaactgcctgggtgggactttyctccttgtcatttacctgccatagataattagacaaatacttcctcratgtctcaggtaatttatttttacagtagacattaataatacctccctcaggtttaatatgaggtttaaatgaggtaatgcatgcaaagcactaataacagaatctctcatgtcctaatctgttagtaattattatttatgcaasgtaaggctaccayaaataagataaaatattaacgtaayatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagagaaacccttcttaaaaacaagatcaaaatatgggcgcacattgttaccacaggtaatgctgtcctgggtattcttatatgaaaatgaaataacaagactagtaatttaaagataaaaatgttattacactgtttaaataccaggaaaaatcaaatactaagaaatctgaaaaataaaaattatctagaaatttcactaacaaaggtaaccaggaatagataaacaattaaagatcaacttcattcaagttaattaaaacctctaaatagaaattataacacttctgcagaaatgattaaataaaaaggaggtatctcagggaggtggacctgaaagaaagattaattatatattttattagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtracttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctyatcrctgytcctgtgctcacagtcatcaattatagacccyacarcatgcgcccwgaagacagaatgttccatatcagagctgtgatcttgagagccctctccttggctttcctgctgagtctccgaggagctggggccatcaagggtgagtgstcaggaggacgcargagcgtyggggtgagtgatggggtggttcacatcaattgytgcttcaggratcasagattttaggggctcattgatctatctggtcctcatagtctatgttccctctggccctcataataataacagcaataayagccagaatttatgagackcctgcataktttctttccccatttacatctcacaggaaycttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcrtacactgccttccccagattcctgcacacagtgacctactaycagggccctcctatctctctgggatccccagcctctrtcttttgtggctgcttyacaggaactccgagctatggactctgcattaggagasgaagtgcraagagtgtttctgtatcctcyctctcttctaggaccctagggctcttcctgggtctttgtgggtggtcacaagctttcctcyctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagytgtctcttcagggcttccctgcccagtctcttaacatttaaacatgtmatttaccttaaaaacataagtgcaaaycaactgataaaaaacaaccttgccttcagtctgcatcctrtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcrgcaattctgatttttggcactcttcctggaaaatcttatttaacctgcrcctgccactaatgactctcagttctmtggcctaaattcctctcctgagaccacccataatccacaaatrtctatgtattatttctccttagatgactttcaggtcttctaagtgcaatagccccacagtraactcagtatcttctcccggtcaggctgtcttccctgagagaagtggcttttgccctgttttctgaatgcctacattgaagccatctgttccccaggaagccttccctgatgtgctgyttggtcgcatcttgtgtataccyacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgastgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgaccycttacyttcttcctttttatattcataagtctttattcattctctagctttsaccacttgcatattcraaytgacattttgtcrtgtttttctctactktctttatgcagcggaccatgtgtcaacttatgccrygtttgtacaracscatagamcaacaggrgagtttakgtttgartttgatgahgatgagmwgttctatgtggatctggayaaraaggagaccgtctggcatctggaggagtttggccrarccttttcctttgaggctcagggcgggctggctaacattgctatatygaacaacaacttgaatayckykatccagcgttccaaccacactcaggccrccaayggtackscctatctttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatacccctstctgtgattcasagctgccataaaatctaaggctgaggtagaggaccaccctcccctaagaggtggagcctttgtgattcatcccagaagaggggcctaacctggtgctgtctccttccagatccccctgaggtgacsgtgtttcccaaggagsctgtggagctgggccagcccaacaccctcatctgccacattgacargttcttcccaccagtgctcaaygtcacrtggctgtgcaaygggragcyrgtcactgagggtgtcgctgagagcytcttcctgcccagaacagattacagcttccacaagttccattacctgacctttgtrccctcagcagaggacktctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcrtcctaacatccaattaactggtccataaccttcaattcccacaaccatcccaggccatcaccaccctcactgcacctcctgaccctatctcttcattcttcccccagakscccaagagccaatccagatgcctgagacarcggagactgtgctctgtgccctgggcctggtgctgggcctagtsggcatcatcgtgggcaccgtcctcatcataaagtctctgcgttctggccatgacccccgggcccaggggmccctgtgaaatactgtaaaggtgggaatgtaaagaggaggccctaggatttgtagaatgtaaggaagggaggaaaaattcaatctgataagtgttcattgatcttctaatgggttaaaagcattcagccrcataacaacaacaayaccgataactaactgagtagttaatatggtcaggcrctattctgaggatttacatttattaactcactttattctcacamatagtctttgaggtaggtactattattttcacyatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaaggaaaagaccaagttsaaattctccagagtccrttgycwaataayggagycagatctatatttctatacataattacaacacagtgtggtgggwgcctgtaactacttactgtctctacttggactcattccatggcaatgytcacacaaaaaatgccyctccagagatcttacaggtttctatytatcataacactcaccatgctttatatttttatatgttttgggaattctcttagcattagacrgtgaacttccatgcagatgaccacatctaattcattattattattgttattcatgctggacctcaggtacaaaaggttragaacttctcagttcattatatgatcatcrttggtgcctccgagctctctctctctcccttgatttatttggtcccttttatctccagtccttactcccatatctaacctcttacccctacctcataggtaaacattttaatgaatttgatgtttccttttatttgcatagatsctcystaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcayggtggaaggcaagtggagccagtgcatcacatggtcatagagggagaaagagacatagaaagaggtgccagcctctttttaacaaccaggtttcatgtgcactaatagagtgagaactcactcatyacccggagaggggacaaagccattcatgagggtctcctccatgattcaaatacctcccaccaggccccacctgcaacactggggatcaattttcaacatgagacttggaagygacaaatatccaaatcatattaatccacatatctacattgctsctgggatacctggatcattcctggttctctactattgcaagcaatgcttgtatctcacatggaactgcatatrcatgtgggcctgacctgcatccctggaatgtatgtatcctagaaaggggttgcagggttgytggagatgcagctccttaatttgactaaayactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactktctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacayttactactttaattcatctgggattcatctttgtgtttgatggggatcatgttttatttttctytatataatgggccagtgtgttcccacaactactaaatagttcaccttttccccataggttagtrgtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaargcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagsgtyaagcttcttctctgccctcagtaatgtggcccttccccttgtctgtatattttggagacatgaagcatgtgggatggcctcamagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatytgaactccagctgccctacaaactccrtcwcagcttttcttctcacttcatgtgaaaactacyccagtggctgactgaattgctgacccttcaagctctgtccttatccrttaccthaaagcagtcattccttagtaaagtttccaacaaatagaaattaatgacactttgrtagcactratayggagattatcctttcattgagccttttatcctctgktytyctttgaararcccctcwctgtcaccttccygagaatacyctaagaccaataaatacttcagtatttcagagcrgggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggttyttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacrtgataaactaagagccaagaaataaawtttttaaaatgccctaattcattgcaatttttaccagccatagtcactccatgtgggagaacttaaatcatgmttaccagagctttcaaaggtttgagaatagtgatgattatgaagaaaaatatcttatttgagcaaggattttgtttctttatgagtgttcattagatattacgatgaaaaaagcatgaaatggtaaaaattcagataaatataaaaacatgttctctagttttttttaagttaaaaaaggaattgtttaaagtaaaaattatttgggggtttataacatacccagaagtaaaatatgatgacaatggcacaaagaatagaagggagaaatggaagtataatgttgtaagtttcttatacatgttaagtggtgtgttattatttgaaggtagaatgtattaagatgaatattttaagctcctgataactattgaaaaaaaaagaggtatagccaagaggccaatggagaagataaaatagaacactaagcataattaattcaaaataaagaaataaaaaagggaaagtctggtaagacaaaaagaaaacaaactgtaagatggtagagtttaaaacaaccatactaataattgaattaaatgcacatggcctaaatattctaatgaaaagggaaagattgtcagaatgcacaaaaaaatctacaggccaacttcatgctctctacataatgccctctttaaatatgaaggcaaagacaggtaaaaagtaaaagaatgggaaaatacatrtataccgtggaatgctatgcagccataaaaaaatgagttcatgttgtttgyggggacatggatgaagctggaagccatcmttcacagcaaactaacacaggaacagaaaaccaaacaccacacrttctcactcrtaagtgggagttcaacaaytagaacacatggacacagggaggggaacacctcacaccagggtctgtcagggcatggggagcaaggggagggagagcattaggacacataccgaatgtatgcatggcttaaaacctagatgatgggttgatagatgcagcaaaccacatggcacatgtatamctatgtaacaaacctgcacattctgcacatgtrtcccagaacttaaagtaaaaaaamaaaaaacraaaataatgccaaccatggaagtattggtggctgtrttaatatcagaaatataagactcagaaatattaccaaggagaaagaaggatagttcataatgataaarggatcattttattatcaacatataacaatcctaaatgtgtttgttcttagaaaatatgtcttaaatcacattataccaaaaatgataaaaataaatcagaaatagacaaattcacaattatattttagtattctagcactcagtaaacaataaaatatttaggaaaaaacttcatgaggacatgatagayttaaataacattatcaatgaaccaacgtgatctaatcaagatytgtagaatattccacccaatagtggcagaatacacattattttcaaatgctcaagaatattccacaggacagactatacactgggtcataaacacatataaataaatgtctaaataaataaatgtctctattgaaatcatacagaatacattctcggaccacaatagcattaaattagaaaccaataacagaaaaataccttgaaagtcccaaatacctagaaattaaaaagtatactgctaaacagcacctggatttaaaaagagtcagaaggaaaattagaaaatattttgaactgagtgaatatgaaagcacactatcaaaattagtatgatacactaattasasaataatttataactttacataattggaaaggagggaaactctaaaatcaaccatctatgttcccatcttaagaagctagaaaaaaaaagtcaaatkaatcccaagattaataagatcagaaataaatgcaataaaatggacaaacaataaagaaaataaacaaagtcaattgctggttttcaataaggctcaatacattcatgaatctctagstagatggatcaagaaaaagagataagactcaaatccccaatatcagaaatggaagtgggtacgtcacaacaaatcatacagacattaaaagtattatgacagaatgctatgaaaatgccaataaacaaaaatgacaataaatttgacaatttacattgttaaattaaattaaatttggtgtaaagctttctccatatcttaaattcctacakagcaaactaacccaacttaacataactgcgttatgcaaacaaactacagcctaacttaagagtgttgtaataaatagctgagtctcagccaatcacaggctgccaagtgatcatattatgtcccccataaggcaaatgcctcatcacrccatgcccatataaggcaaacactgagctgtaataaattggctggttttgagtatcacttcctgtttttatctataaacactgccttcacatgttgctggacagagctttctgaatctttctgggttctgagggctccccaattcatgaattgttctttgctaaataarctctgttaaattcaacttctctaaaatttttattttaacaayatgaaatagaarcatttcttgaaygattcaaattaccaaaactaaatcaagaagaaatctctgtcaatggaagaaattaagtttgtaattttaaaaatccttctcacagagaaggccaaatggtttccaggtcagatggcttcattgattaatccatagtattctgtcataatactgtcataatacttttaatgtctgtatgattaattctattatacatttaaggaagaaacaatacaaactcaatacaaactctttcaacaaaasagcagaagaaaacacatcccaataatttacaagtccaatatactaacaycaaacaatgacattaaaagaaaaggaaactaaagacacacaaacatagccatgaaaatgtttaacaaaatattttttaaaattgaattcaataatatattaaaaaggatgatataacatgatcataaaagtttatgccaggaatggaaggcatgtttaacatgcaaaaaatcaatgtgattccacatcttaacagaatacaaaagaaaaattatgtaattatgtaaatggatgcagaaaaaggcatttgctcattcatgataaaaagtcctagaaaackaggaataaaarggaattacctgataaggtgtgtccatgaaaaccaacaactgaaattttcaattttgggtgggggaggggggcgggcattttactttctccataaaactattaaattatctaatgtgaaagtggaattcagtgaagaaatgttccctactgcaaaaatacaaaatgctggacattctgtgaacagtttctatgcattctatataaatgaaactattaactatataatacatttattgaaaaaagaagatggccttctttttttttcctaatggctgttgaatttatttgcttgatcaataatggtcctggcaaaaattgaccaatgctgagacatttgtaatgaaatactaattttaaaagtccatgacaccttgatagaaattagagtttacacaaacaaaaaaggaaccttcgatatttccagcagctayaaggtgaatgtactgagaccgacaggacagcaagaaggcatttgcacatttatatctgacaccagaccacactttcagycaccagaatatcttctctccatattttaaaaaatagtgtctctccctctccctctccccacggtctccctctccctctccctctccctctccccacggtctccctctccctctctttccacagtctccctctgatgccgagccgaagctggacgrtactgctgccatcasggctcactgcaacctccctgcctgattctcctgcctcagcttgccgagtgcctgcgattgcaggcgcgcgccgccacacctgactggttttcgtatttttttggtggagatggggattcgctgtrttggctgggctggtctccagctcctaaccgagagtgatccgccagcctcggcctcccgaggtgccgggattgcagacagagtctcgttcactcagtgctcaatggtgcccaggctggagtgcagtggcgtgatctcggctcgctacaacctccacctcccagcagcctgccttggcctcccaaagtgccgagactgcagcctctgcccggccgccaccccgtctgggaagtgaagagcgtctccgcctggccgcccatcgtctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcctggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaggaacccctccgcccagcagccaccctgtctgggaattgaggagcgtctccgcccggcagtcacctcctccgggagggaggtggggggggtcagccccccgcccggccagccgccccgtccggcaggtgaggggcgcctctgcccggcccgcccctactgggaagtgaggagcccctctgcccggccagccgccccatccgggagggaggtgggggrgtcagycccccgcccrgccagccgccccrtccrggagggaggtggrggggtcagcccccyrcccggccagccrccccrtccgggaagtgagggkcgccycygcccggccgcccckwcygggargtgargrgcscctctgcccagccagccgccccgtmcgggwgggargtgrggrgtcagccccctgccccgccagccgccccgtccgggagggaggtgggggggtcagccccccgcccggccagccaccccatccgggaagtgaggggcgcctctgcccggccgcgcctactgggaagtgaggagcccctctgccccgccaccaccccgtctgggaggtgtacccaacagctcattgagaacgggccgtgatgacaatggcggttttgtagaatagaaacgggggaaaggtggggaaaagattgagaaatcggatggttgccgtgtctgtgtagaaagaggtagacatgggagacttttcattttgttctgtactaagaaaaattcttctgccttgggatcctgttgatcggtgaccttacccccaaccctgtgctctctgaaacatgtgctgtatccactcagggttgaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtga

SEQ ID NO: 13213 - DNA, 18930 bp, Homo sapiens
ttggaggaaaaaaaaaaatccgccaactgctgagagggtgccccttaaaacatgtgatcctcagcgtcacctgggccccttcaccaccaccctcagccttcccaaccccacccaccaaggccccttgagatgagccgactgacgtctccctggaagaaacaagccacaggacggaccagcctcgacttcctgccatcgggctcacaccctacccgcacctgacctgccctttccttcttccttcccgaaacaatgtaagaggagtctttccccatgtctggggctaatcccaccacatcgctggttgcaccatccactcctttgttcttgaacatttcgtgaggyggttgagagctctccacctgcgttcaaatcacggcgcccccgttcagcgttgtgtaaccttggcacgtggccgagcatctccatcttggcttcctccatctgtacaatgaggggagtaacaataccggaggtactcatgagctctcccatggctacgggaaggtgtcagcaagttaattctcgtgaaatgtgttcaaatcgtgttggacacacacatcggtgtgcaaatgaacttgttagtggccttgggagacaacagaaggaagagtttacagtgtggagcggaggttcggacagtcctggagtctctgatacctcctgcacctaccagctgtgggaccttggacaagccacctcctctctcagcctcagtttccctgtctgtaaaatggggacaagttagtgcctctcccgaggagtccagactttccatgacctcactatcctcactgtctattctcccctcacccacttggccccccactgaccatcttgcagttcccaaacctacagaccccttccactgcagggaagcccttgctgccaccttttcatagaccctcataacttgtaatgtcgtatatcgtatttatttmctttctttttcttccagaatatacagatcagtagggcaaagatttttttggaaggggtatctattgtgttcattgctgtatcccctagaactatgagggtgtacatagtaggtgcttgataaatatttgctgaaaagaggtgggggagaaaaggaaggcagatgggagaagagggagagatgaagggaaagagggaggaaaagaaagggaagacactaacccagataaagaacttggctggttaaacagaatgtggtctatatacacagtggaatagcaatcagccttaaaaaaggaaagaaatcctggcacatgctgcaaygtggatgagtgttgagaacattaggttgagtgaaataagccagtcacaagaggacaaatatcatatgattccttttggccaggtgcagtggctcacgcctgtaatcccagcactttgagaggctgaggtgggaggagaatcacttgggcccaggagttcaagacaagcctgggcagcacagtgagaccccatctctacaaaawatttttttaattatctgggtgtagtggtgtgcatctgtagtcccagctactcaggaggctgaggtgggaggatcgcttgagcccaggaggttgtggctgcagtgagctatgactgcaccaactgcactccagcctgggtgatagagtaagacttatctcttaaaaaaaaaaaaaaaaaatccaattcctattatgtcaggtacctggacctagagtagtcaaattcatagagacagaaagtcgaatgrttgttgctaggggctggggaagggagaagcagggagttatcatttagtgggtgcagaatttgaggacaatgaaaacatctgggggagttagagagtagtgatggctacacagcaatgcgaatctgctgaatcccactgaattgtacctaaaaatgtttaaaatgcttgattttgtgctttttttttttttagatggagtctcactctctcgcccaggctggagtgcagtggcataatctcggctcactgcaacctctgcctcctggtttcaagtgattctcctgcaacagcctcccaagtagctgggacgacagcgtgcgccaccacgcccagctaatttcttttgtattttagtaaagacagggtttcaccgtgttgcccaggctggtctcaaactcctgagctcaggcaatctgcccgcctcggcttcccaaagtgctaggattacaggcgtgagccactgcgcctggcctatgctgtgtttattttacaacaataaaaaattgtaaaattttcttaaaatttaaatattttttaaaaggtctcatctgccgggcgcagtggctcacgcctgtaatcccagcactttgggaggccgaggcgggtggatcacctgaggtcaggagtttgagagcagcctggccaacatggcgaaaccccgtctctgctaaaaatgcaaaaattagccaggcatggtggtgggcrcccatagtcccagctactcaaaaggctgaggcaacagaattgctttaacctgggaggcggaagttgcagtgagccgagatcctgccactgcactccagcctgggtgacagactgagactcatctcaaaaaaaaaaaaaaacaaccaaggtttcatcacagtccctggctgtgctgagcacagaatacatgtgagtgattgtttttgttccaagtgccatccaggttttcctttcttataaacagccatcagtatcaaccacccttctcctcccctcacacccaagagctgtccgcacctatggtctcctctgctccgcccagcttccacccctaccacaccacaaaaaacctttctctccaaaatcacccatcacctatcttccttccagaggcatctgaccgcccctgccactccctcgtttaaaaaatgctctctggctgggcgcagtggctcacacctgtaatcccagcacttggggaggccaaggcaggcaaatcacttcagccctggagttggagaccaacctgggctacatcgtgagaccctgtctctacaaaaaaatacaaaaattaactgactgtggtagcacgtgcctgtagtcccagctactcaggaggctgaggtgggaggatggttgagcccaggagttcaaggctgcagtgagctgtgattgcaccactgcactccagcctgggcaacagagtgacaccctgtttaaaaagaaaaaaaaaagctctcaactttcctgacactgctccctcctggtgtccctcttagctcttcaatcactcctacccctggcataactgtttcttaccccctgagctgtgagtcttcagtggggtcctctcactgtatacyctctccctaggtgggctccacaccgctggtatccagcaccatccgtgccgtgatgccccatcactctcctgagctccagacctgagtatcccgaaggattctgctctcccctactcaggatcatgccaccatcccccatcaccctcggagtaaaattctcgcccctgcagcaccagggccctgctcatcttggccactcctctctcctacgctctgagctctctcaccatcctcctgccccaccatccctactcgaaaccactcacctccctcctaccctctccacacactgtccatcctccctggcaaactcctattcatctgcaggaacctgctaagactgcccctcctcctggaaccctttcccacacctgaggctccatccagcccctcagcctcctccaggggagcacacgtgacaccagatggagtttcctgttgccccgctggcctgtttcaccagaccgtgagttcacagaggagcagcgactgaggctctgtgttcattcattcatcagatgtttatcgatgcccgtggcacagcaaacaagaccgtgccaagcaggtggtggagtggtgagcgagataccctgggaacctagcatgtggtgggaagagggcccagcaacctggccacggcacggcaggtsstgaggtccgggctggggacggcaagtccttgggagccaccggcggtgaactgggcctcatcagctgcatctccagctgtctccctacctttgagctgarggccttggggagccttccagtcattctgtgccctggctcaggctctgcataaacacaagaaccccctctttatttatttgtttgttkatttatttattttgcaacagagtctcgctctgtcacccaggctggagtgcagtggcacaatctcagctcactgcaacctctgcctcccgggttcaagcgattctcctgcctcagcctcctgagtagctggggctacaggcacccaccaccatgcccagctcagtttttttgtatttttagtagagattgggtttcaccatgttttccaggctggtcttgaactcctaacctcaggtgatccaccttggcctcccaaagtgctgggattacaggcgtgagccacagcacctgcccccctgccaccctttaaagaaaggattctcttggatctcagggatagagtggcatgaaggagccactcccaggctcctgggggttgaccaaggccttctgcttaagtagggtgttctttttaggaacagggagaccttgtgtttactaggaaattctgttttatttttaactttttcctttgagataattacagactcacaggaggctacacacacagcatagggaatctccctcacctacttctccccgtggcgacaccttgtgtaactgtcgttcagaatggaaaccaggaaatcaacacagaaaccaaactattaatgagactacagatcacactgcgcgttcatttttcacacgcatttctttgcacgtgtgtgtgtgcacgtgggcttctgtgtctctttatctcatgtgtagaatcgtgtaatcaccgccacatccagtgcaaagctgattcgtcaccacagagcagctccctcctgccaccccatccctgggtcccaagagaaccctttcttaaaagagggagttcttgacgggtgtggtggctcatgcctgtaatccttgcactttgggaggccaaggagggtggatcatttgaggtcaggagtttgagaccagactggccaacatggtgaaaccctgtctttactaaaaatacaaaaaaatgagcggggcatggtggtgggtgcctatagccccagctactcaggaggctgaggcaggagaatcgcttgaacccaggaggcagaggttgcagtgagccgagattgagccactgcactccagccggggctaaagagtgagactctgtctcaaaaaaaaaaaaaagaaaaagaaaaaaagaaaaaaaaataaaataaataaataaataaaataaatttaaaaatttaaaaataaagagggggttcttgtgttgatgccgagcctgaaccaaggcagaggaggccgggaaggcttcccaaggccttcagctcaaagcagggaggcccatagttaaacagaaacagttcaggaatcacagaaaggcacctggggagagatgggtgtgtggctccagatgcaggtgcccagacagtgcgtccccaggtgtacagacagacccaggccaagctccagctcaaaragccagcctaggggggtgccgaggtggagggaggctgagtcaggctgaggccggggaacagttggggtagccragggaggcaagcagcctcctgagtcaccacgtggtccaggtacggggctgcccaggcccagagacggacacaagcactggggaatttaaggggctaggggaggggctgaggagggtaggccctccccsaaatgaggatggaacccccccaactccagaacccccctgcaggctggccagaatccttccccatctcattcactctgtctctcctgctctctgccgtctcctattttgaatttccaaccccrtctgttaagactgtccttctgtctctgaatctctgtccccttctctttctgggtctctctccctctccctctgggtctctgtccccctctctgggtctctgtcactctctctttgcatctccagctctcactttgtctctgcacctagcagatcccaagctggggaatgccagttctggcaccaaccttcctgctccctgctggggcctctgctcccccatctctcaggagtcgaaagtgagaaagcaaggtgggcagctctgctccaggtccaggtatctcccgcccacctcctgcccgtcctctatcccacccctcctctccatctctccctggcgctgccatctctcatctmggcctccgtctcctctgtcattgtccccatcccctgtaggtgcccatccttcccgtctcccctctgccatcggcctgcctgtcccatcctctttctcccaccatgtcccgttctcttccacgtctcatgcccgcactgccttcatcatcatcgctgttgttctgtgtgtgtttgtggtgagtgccgcatggtgggggcgtctcggcctctctcctctctctccactgttttctctttctgtgtgtctgtttccattctatctccaccttcttccctccgtyttttgcttttctatctccacttctccacacccctctctccctgcgtctctgtgtctccctcttcctctgtcttgtttttttcccaccgtctgcctcttctgttccctgtcacatccaacttccaccggtttctccagctctctcctcagttccttctctcatgagcacacctgcctctgtgctcgtattcctggactcctctctctccactgtcatatcttctcattcattttcccagtctctctctgtctcttgctctccccctctctgtcactctgtctctgtctctctctttctctctctctctctgtgtctctctgtctggctctctctctgtctctctctccatctctctctctctctcccccccgtcaccctgtctctgtctctctctgtctgtgtgtctctctgtctttctctctctccatctctctctgtctctctctctctctctctctctctccctctctccctcctcccgtgactccctctctcagtccatctcttcctccctctctcagccccttcgtgccctttcctctgacactccccaccctggtttcctgactccaccactagatccaccacctccagcaactgggaaccctcccctgcccaccctgccctggggtcccctcccaggattccttctagattatagcatcttccctgggcgggttctcatgaacaattgtggctgcttttttggccagacaggggagggaggggatgggatcagggagtcctggaatgggaactaggcaataaaaaaaaaaaaatgtcagaagcagggcggcgggaggtgggggcagggccagctgtccttaccagggataaaaggctttgccagtgtgactaggaagagagacacctcccctccttccttcatcaagacatcaaggagggacctgtgccctgctccacatcctcccacctgccgcccgcagagcctgcaggccccgcccccctcgtctctggtccctacctctctgctgtgtcttcatgtccctgagggtcttgggctctgggtaagtgccccttgctgtctctgcctctcagcccccggttctgttgaaggttccttctctctcactttttctctgcatttgacaggacctggccctcagcccctaaaatgttcctcctgctgacagcacttcaagtcctggctataggtaaragaacggttgggtatgacacaagggggtcccctggagactctgagaagagatggggatkggtccttggggcccctggatgctcatggtgacctcataagaaagagcagggagtggtttgggggtcatggtgggggaacgtgctggaggcctaaattcctagttgtggaggtgctagggaattgtggggccggggagagaggtgtttataagrtctggtgcaaaatacataaggaatcttagggaactattaggtcctgagtgggtcatagcagaaagatcacggggctctacctgactgtgttaggaaagaaacaatgtcagaaagatgttttgttgtcagagggaaggtggagaaggatgatgggrtggcgggatcgtggcatggggtggcgggatcgtggcatgggtgtgtgaggtggatgggggcaagtgtggggcaagagatggcggatccttggggtcccactgagtgggaacgttggggaggagacagggaggtccttgaatgtgttggggaaggactcattggggggaaatgtggcatatttcgagaagtgatcacagaarttatgggagcatagagctaagggtcgtagatgtagcaaggccctggataaggtggccacggcacaaaataagagatgctacggaggtgacttgggaggtgagtcagaaagctctcygtgytggggcaataacggggtcaatattggrcatgtctcaccctgggtgggmcagatagaggcgggcagtttaggggytagaccaaaaggaaggggatttgtcagttttggaatcctacaaacttgtggagtggagagtgtttgctcatctackttccccacccaatcctgtccactcctagccatgacacrgagccaagaggatgagaacaagataattggtggcyatacgtgcacccrgagctcccagccgtggcaggcggccctgctggcggrtcccaggcrccgcttcctctgcggaggcgccctgctttcaggccagtgggtcatcactgctgctcactgcggccgcccgtaagtgaccccctcccctgtccctgtacctagtgaattccagagyctaaagccctagagctgagctgagaacctggatctctgtatagaacccaatgtagtggctggctcctggtttgaggtctagagaagagcctggaacaaaaacacagctcgggatgtgggctcctccataaatctcgaactcagcmtaggttctgaaagcagatgggcagcttggaacccatggacctgctgagaaccgaacatctgatccagtgattcttccagaggccacacattacatcgagaccaagcttagcccattccagattggtggctgaattcaggaccccgtctacattcagaaactcaggacactacgtagaactcagagcccagttcaggacctgcagtctagccataaatccagaactagaacgctgctcacagctggaacatacaactctaagaatagaggcaaaacctggaggctgtttcacacccaaggtttagttcagagtctagtytatagctccgctatgagcagacttcaacccagygtttgaatcccagaatgtggcgggtgcggtggctyatgcctataatcctagcactttgggatgctgaggcaggcagatcacctgaggtcaggagttcgagaccagcctgascaacatagagaaaccctgtctctactaaaaatgcaaaattagccaggcatggtggcacatgcctgtaatcccagccactcrggaggctgaggcaggagaatcacttgaacctgggaggcggaggttgcagtgagtcaagatcgcaccattgcactccaggctaggcaacaagagcgaaactccatatcaatcaatcaatmaataaatcccagaatgcagatcctaatcagaagccccatataaaacctagacccctcctaaattctagatctgaacttacaacccagaccccagccaagaggtcaaaatgcctataagccatatctatgccataaacaggtcagtctagaacctagagatcaaagctcaggccagagtctagaatataaaggccagaatgcaaaccasactctagaatcttggatccgggccataacctagagctccaactagaacccagagcccaacctgaggtcaagggctagggccagagtccagaaccaagagccctataatccartatgaaacagacctgtagaggctgggtgcggtggctcacgcctgtaatcccagcactttgggrggctgaggygggagaatcacttgaactgggagttggaggtcgagagtgagctgagatcgtgccactgcactccagcctaggtgacagagcgagactccatcacaaaaaaaaaataaataaataaatmaagtcataatccaggttygatctagaatcctgatcttagcatagagtcaaaagtttaagatgtctagaactcagaacccaggctagaaacagaatggtgcctactccggaatatcagttccgatttagagcctagactcataacgcagtttcgcttaggactcaatgcaccgagcccagcacagaccctggcacggagccaagctctcccaatcatcaccttcttcccaagccaggagctggagcccagcccaagagcggaaggagaggcagctggggctgggccgagagaatgccctggccatggggaagggcacaggaggccaagaatgctcggcctgcagttagtgagaagcaggctagacctcggggaagactcgtcacccggccagggaaccgggctggagggtggggaggagtctcyggctcagamcctgagcagcgcttctcttgggggtcgtggccaggatccttcaggttgccctgggcaagcacaacctgaggaggtgggaggccacccagcaggtgctgcgcgtggttcrtcaggtgacgcaccccaactacaactcccggacccacgacaacgacctcatgctgctgcagctacagcagcccgcacggatcgggagggcagtcaggcccattgaggtcacccaggcctgtgccagccccgggacctcctgccgagtgtcaggctggggaactatatccagccccatcggtgaggactcctgcgtcttggaaagcaggggactgggcctgggctcctgggtctccaggaggtggagctggggggactggggctcctgggtctgagggaggaggggctgggcctggactcctgggtctgagggaggagggggctgaggcctggactcctgggtctcaaggaggaggagctgggcctggactcatacgtctgagggaggaggggctggagcctggactcctgggtctcaaggaggaggggctgggcctggacttctgggtctgagggaggaggggctggggacctggactcccgggtctgagggaggagggactgggggtctggactcctgggtctgagggaggaggggctgggggcctggactcctgggtctgagggaggaggtgctggggctggactcctgggtcggaaggaggaggggctgggggcctggacccttgggtcttatgggagggtagacccagttataaccctgcagtgtcccccagccaggtaccccgcctctctgcaatgcgtgaacatcaacatctccccggatgaggtgtgccagaaggcctatcctagaaccatcacgcctggcatggtctgtgcaggagttccccagggcgggaaggactcttgtcaggtaaggcccaggatgggagctgtggtagggattatttgggactgggatttaagcaaatgatgtcaggagcatggaagtctgcagaggtcttcagaagagagtgaaccgcaggcacagagagattccgatagccaggccaccctgcttcctagccctgtgccccctgggtaatggactcagagcattcatgcctcagtttcctcatctgtcaggtgggagtaaccctcttagggtagttggtggaatgggatgaggcaggttggggaaagatcgcagagtggcctctgctcatatgggtctgggaaaggctgtgctgaggcttctagaaatcttaatgcatccttgagggaggcagagatggggaaatagaaaaagagagacacacaaatgttctacagttggagcgaacagagaggggcctggtgagattcaagggacaggcaggtgcacacagagacagagccagacccagcggagagggaaggaagtgccccgacctccggggctgagacctcagagctggggcaggactgtgtccctaactgtccaccagtgtctctgcctgtctccctgtgtctgcttctcgggttctctgtgccatggtggctctggctacctgtccatcagtgtctccatttctgttcctccccctcagggtgactctgggggacccctggtgtgcagaggacagctccagggcctcgtgtcttggggaatggagcgctgcgccctgcctggctaccccggtgtctacaccaacctgtgcaagtacagaagctggattgaggaaacgatgcgggacaaatgatggtcttcacggtgggatggacctcgtcagctgcccaggccctcctctctctactcaggacccaggagtccaggccccagcccctcctccctcagacccaggagtccaggcccccagcccctcctccctcagacccgggagtccaggcccccagcccctcctccctcagacccaggagtccaggccccagcccctcctccytsagacccrggagtccaggcccccagcccctcctccctcagacccaggagtccaggccccagtccctcctccctcagacccaggagtccaggcccccagcccctcctccctcagacccaggaatccaggcccagcccctcctccctcagacccaggagccccagtcccccagcccctcctccttgagacccaggagtccaggcccagcccctcctccctcagacccaggagccccagtccccagcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccgaataaataatgacaataaaaatggaatcatcctaaattgtattcattcatccatgtgtttactttttattttttgagacaaggtcttgctcagtctcctggtgaaatgctgtaaygcaatcatagctcactgcaaccgtgacctcctgggctccagtgatcctcttacctcagcctcccgagtagctgggaccacaggtgcccgtcaccatgccccgctactttttaaattttgtgtagagatgaggtttccctgtgttgctcaggctggtctcgaacacctgaccccaagcaatccgcctacgtcggtttcccaaagtgccgggattgcaggcgtgagctgccgcgcccagccttatccatccaattaatgacttcaagaaacatgtacacagtggccccaccatgccaagccaggagctgtgtactgacaagtggctgcctccctctttgcgtgtttttccttgggagtcccccgtccaccccactgtatcaggtttctagacggaaacacctcagccctgcagagtgaccttgagcatgactgccttctaccagcctcctccctggagcccctgtggtccagggtagggaactaagtgccttgtttcctggaaaattctatgcaaatgaagatgtcctcattttcctaatcagatctcaggtgaggagagttgagttaatcacaggcttcagttcctgcccaggcaaagcccttctctcattttattaatttatttccactcttcatctctggctctgctcccctccctccccacaggcaccgacataaatggctttgagtgccctgcatccttggaaaacaaggcagtgtcacagtgtactgtttctaatttacatgaaaccattgtgttaggaatctcattctctttcttactttcactcatcaacagctattgagcacctactacgggccaggcattggtctatttattaggcacctgctatrcaccaggcattgttctgggtgctggaggaagaactgtgagcaagccagtcagaatccctgccctcacagaacttatattctagcaggagatgacagacaagaagccataaacataattttaaaataaagcagagtccctatgagtaacgaggtcaataaacttgggctgggcggcaggcccaatgtgtgccagggccagctcatacatgctcgcaagagtctaccagcaaattttcaggaatttcgagaaccagttgctaaatgcagccatcattaaaaattaaattacataagcgtataattacataattgattaaaaaaattgtcagtaaatactcaaaactcaactgttgctaattatttcaactaatacctatgcttgggagtgagatatgtctcttgtactacgtctgtaatgatgagtttctgcacacctctttccaactccccaactctgtctgcaccagtagcttgacaatagccaaagaagaagtatttactgcactgaaattgaaaaacactatagatagggctttgccggacagtcattgctaaacctttaccaggcacccttggatgggtctgcctgggaatgacctcatgatcttagtgtctgtcttctcaaagttctgtgcttggatactgcagagtatagctaaaatagaatgttgtactcaccttatgttctatggggacagcacagtattggggaaccctaaggtggcaggtctgggacatgcacgaaagattgctgggaagtagaggctccctccttttcctcatcctcccaycccatcctccagtgtctggtaaccaccattctactctctgcttctaagagtctgagttttttagatttcacatgtaagtgagatcatgcagtaattgtcattctgtgtctgacctatttcacttaacacagtgtcctcccggtccatccatgttgtcacaaatgacaggatttctttcttttataaggcagaataatattaaattatactgatactaatatattacatttcctttatccattcatccatcaacagacacataggttgttttyatatcctggtcatcatgaatgatgcygccatgaacatgggtgtgcagatatcactttgagatgccaatttcatttccttgcaccaacttacactccaaccaacagggtacaaggattcactttttttccccacatccttgccagcrtttgttattgtttgccttttctatactagtcattccaaaatgtgtgaggtgatgtcttactgtgattttaatttgtgtctccctgatgattagtgatagtgagcaccttttcacatacttgttggtcctttgtatgtcttctttggagaaatgtctattcagggcctttgcccttttttatttttcagagacagagtctctccctgttgcccaggctggagtgcagtggtgcgatctcagctcactgcaacctccacctcctgggttcaagtgattctcctgcctcagcctcccaagcagctgggattacaggcatctgccaccatgcccagctaatttttgtatttttagtagagacagggtatcatcatgttggccaggcaggtctcgaactcctgacctcaggtgatccacccacctcagcctcccaaattgctgggatttcaggcatgagccgctgcgcccggccctttgtccattttttaattgggttatttgttttcttgctgttgatttttgcattgcttatatatcttggatattgaccctctatcagatacatcatttgcaaatattttctcccatttggtaggctgtcttttcactctgttgatcattatctgttggttgtttcctttggtgcacagaagcttttccatttgatgcaatcgcatttgtttatttttacttttgttgtctgtgctttgggggttatatctaaaatatcattgcccagacaaatgtcaagaagttttttccccatgtcttcttcttgtcattttacagtttcaggtcttatgtttaaatccttaacccattttgagttgatttttgtacatggcatgagataggagtccaatttcattcttctccttgcaggtatccagtttttccaacagcttttgttaaagagaatatccttttcctttgggttaaagatcagttggcagtaaatgcatggatttatttctgagctctctattctgtcccattggttatatgcctgtttttgtgccagtaccatgctgttttggttactataactttgtattatgttttgaaatcagacaataagatgtctctagctttgttcttcttgcccaagattgcagggtctttcatggttccatatttatgattttttttctacttctgtgagaaaaagccattggaattttgatagggattaaaatgaaaatgtagatagctttggttagcattgacattttagaaatattaattcttccaattcacaaatatgggatatctttcaatttctttatgttgtcttcaattttttttatcagcattttatagttttcagtgtacagattatttacttccttgcttaagtttatttttaagcattttattgtttctgatgccattgtaaattgagttgctttctcaatttttttctgataattcattgttagggtgtagaaacacaaccaaattttgtatcttacaactttactgaatcatttattagttctaacagtttttcggtggactcttcagggttttctacatataagattatgtcatctgcaaacagagacaattttacttctttctttctgatctgaatgtcttttattctttttcatgcctaattactatggctaggacttctagtgctaatgttgaatagaaatggctagagtgggcatccttgtctttttcctgatcttagaggaaaagctttcaagttttcaccattgggtatgatgttagctgtggacttgtcatatatggcctctattgtgtgaggtacattctctctatacctaatttgttgactgtctttatcgtgaaacgatattgtattttgcaaaatgatttttctgtacctattaagatgatcatataatttttatccttcattctgttgaggtatatcatgcttagtgatttgtgcatgttgaaccgtccttatatcccagggatraatcccacttgatcatggtgtatgatgtttttaatatgctactgaatttagtttgctagtgttttgttgaggatttttgcatctatatgcatcagagatactggcctataattttcttttcttatagtgtccttgtctcagtttgtggaggttgcaccttctgtgtcaaggtgataaacacacactgtggatttaatacttagcagccatamaagccctataggaaaaaggagagaaaagaagttgtgtacttgggtagatttgggcacccagtgacatgatataactcatgctataattctcaacctgcatccttctataaagctaaataaaaatagtttaaagactactttaattttatttgcaactcaaagttccagctatggtggttgaacattatattttattgatttaaagacacattcttttcatatktttcacatctctgaaattaggaagcatcttacatcttaattcagcatgatgtcttacacctcataatttaattggcaacttctttttctttmtgagtggtctacaaaataaagtgcaatataatcaacagtattttacattcaattaaatagtgtgtgaaggaaggtaggtgtaggtgaggggtcaggttgtattattaaatacgtcatctgatttcgtcaaatcatcttgtaacaatctatctgcatcactatttgctcatctagttcactgcttctaactgccccagagtcttctagacatatgttgtccaatatggtagccgttagccacaactggtgtggccatttaatttttgattaaaattaattaaaattagatgcaccttaaaattccattccttagtcatactcacaacatttcaataaccgtacgtggctagcggctgccatattgacagcacggatataytatagatagaattatttgcatctcatcactggaagtcccattgaacagcactactctggtttttgcccttgcttcacatagcgtggtgcagaaaatagcaattctgaatcacttattagaactggagtcttagatctcacccagaccaactgaatyggaatctgcgttatatataacaagattgccagggcactcagtgcatgttaggatttgagaagcgccgctgcatagtacacatccaccatgtttagtaacccagtccttcagtgatggacacctaggttcccttcactttgagygtgccacttatgtatctatacaagactcctcttgaccattcacacaggagtgggaccaaggggcctaaaggcctattcttaatcaatttcaccgaatactggcaagtttttgtctaacaaagaagggttcgaccaggtgcggtggctcacgcctgtaatcccagcactttgggaggccaaggcgggcagatcatgaggtcaggagaccgagaccatcctggctaacacggtgaaaccccgtctctactaaaaatacaaaaaaattagccgggtgtggtggtgggtgcctgtagtcccagctactcaggaggctgaggcaggagaattgcttgaacccgggaggctgaggttgcagtgagccgagatcgtgccactgcactccagcctgggtgacagagagagactccatctcaaaaaaaaaaaaaattaggtttcttccctctccacaccttcaacaatatccatatttgtcactgacggttcctacrgaagtgaatgaagggggacgaatgcagaaataaagacaagagatctgttttgaaagaatgtgtcagggagctccttgcttctggtgagcaaaggcagccttgagcttctacagcccttcatttatattaggtagaaagagcagggagggagaggtaacggttgatcagctgcttgattaatcacaggtacatataattgttttctttgtacaacaggc

SEQ ID NO: 13214 - DNA, 19277 bp, Homo sapiens
cacctttcaggattgaagctcaggattggaatccagattgatgccatgtgggcaccagctgatttatgctcaagttgaatgacatttatggacaagagccacaggaaaactgacagcagagaccttgctattttatgaaggaaaatcacgtttacagtgctgacctacacatgcaaatttacggtctcaactgatcacaagcctctttgggatctcacttcatctgaggatgagctgccaccytaaattatggcaccaaagatatagttccaaatcttctgttcagktcctatgactctgaccttgtctacttgtcagggagaataacaatgaagacaggcatatcgagctatctactcaaatcagccagggtttctcttccagcactactgatactttgaatcacaaaattatttgtctgggggggcggatgggcgggtgaggggctatcctgtgtaccgtagaatgttcagcagcatttagcaacattcttctacccactagatgccagtggcaacccccttcctccaattatgacaactcaaaatgtctccacacattgccaagtgtcccctggggagcaaggccatctccaactgagaaccacagaaatagatctttaatatattctgtcaaatttttgaaaagacccttgtctctcagtgatgaaaatgcctgattgactcatagctcaaaccraatgggaaaggaataactaacaataaaagctacctgaattcccagcactttgggaggccaaggcaggcagatcacgaggtcaggagataaagaccaacctgggtaacacggtgaaaccctgtctctactaaaaatacaagaaaattagccaggtgtggtggcagccgcctgtagtcccagctgctcgggaggctgaggcaggagaatggcatgaacctgggaggcaaagcttgcagtgagccaagattgagccactgcactccagcctgggcgacagagtgagactccgtctcgaaaacaaaacaaaacaaaacaaaaaactacctgaatgtaccaaatagcaattgaagtttgcaaacaatgaccttgagtcatctgcttacagaaggtgtctatctgtcttttggacaaaggacttctgatgaagaggatggagtggaccatattctttaatccatgacgttatttgtccccatcaaatacaaatatctaaatgtatttatatattttcattatcactagtcctcattctcattcccctcactccccagtgggatctatcctactaatatatayccttttgtctgtgtctttgtataatgtgtactattttgaatatatcattctcatttaagtcaatagagttccgcaatcacttactcrcaattcttaaacttacacagctctggacaccagaagttttctcttaaattcttaacagcgaaatctgactgaagcgacaaggggttacttggggttctttagccactcaatgtaactattcctatgttttgctgcggaactattatgcttgattatgcgatgccacctcttccttttctaaattccaagcattttgaattccaaaaacaaatctgagcccccccatttttttctttttctttctttcctttttcttttcttttaagtgagacagggtctcactctgttgcccaggttagagtacagtgacacaatcatggctcactatagccttgaccttccgggctcaggtgatcctcccacctcagcctacttggtaggtgggagtacaggcaygtgccaccatgcctgactaatttttgtattttttrtggagatggggaatccctatgttgcccaggctggtctcaaactcctgggttcaagcaatccactttccttggcttcccaaagtgcttggattacaggcatgagccactgtgcccagccccaaagggttttaattgtctacttatacattatagagagagatcttactctgttttcctgtttttactcagtattatatttttaatacatatccatgttactgcatgtacatctagtctattacttctaactgccgtagaatactccatgaagtggatccctacattccactcacccactcccccagtaatgagcagctacattgcctccagttccccatcactacaaacaatgacttaatgaacatcctcatacatgttcctttgtggacctgtatgagaatctccataggatatacacccagggttaacagctgggtcatgggtgtgaatatacttaatctggtcaaggaatgccagaatacccttcaaaacagccatgtcagcctactggcatggtgtgatataatagatcctgtagtcccccattttcccaacacttaccagtatccagtgttctcaacttgtcagtctaagaggtgtaaagagatatctcattctttttttcatttgcattttctgatataactgagcctccaggtatgctcattagtctttggggtttcttctcgttaaattgcttattcatgagctttacgcattttttactagtgtttctgtctttttcttgctgacttacaagagttccttgtttttagacattgaaaatattggttttagacactgaaaaatatcttctctcaatctgtcagctgtctgttcatttggttcatgcatagaggaaatgtgtaaaacagaaatcttcatttttatgtaatccaattgataggtattttgccttatggtttggagctttagaagttttaaaaaagtccttcccacttataagtgacaaagacagtcctctatattttcttctactactgtaacaattttacttttcacatttggtctttaattcacttccaaatggattcacctctgttgttttagattggagtccagttttatttttcatcatacgctgaacattttctctttttaaaaaaattttttgtagggagtttttgctcagactggccttgaactactgacctcaagcaattctcctgccttgacctcccaaagtgctgggattacaggtgtgagccattatgcccagcccattgagtattttctactaaatattgcatgttttcctcattgatcagggaatcatctgtattatcttatacttaatacccaaatatacaaatctatctataatttctctactctgtttcaatggtccatatgcctgatctgttgcaaagatcactactttaatttctatggctttaaattatgtccatatgtgatagggttagtcccccttttcattattcccttagcatttttacttaaggccaggaacagcagctcacgcctgtaatcccagcactttgggaggccaaggtgggtggatcacttgagcccaggagtttgagaccagcctaggcaacaaaactagactccgtctctacaaaatacaaaaataaaaattagctggacatgatggtgttgcctgtggtccaagctactcaggaggctgaagtgggaggatcactttagcccaggaggtcaaggctgcagtgagctgtgactgtgccaccactacactccagcctgggtgatacagtaaaaccatgtctcaaaaaaaatttttttaacttagtcatagattttattacatctgtattttagagtaggcttattattaagtttctgagaaaatttatttgtagcttgtattggaattacattgagcatgtgaattaacgaaaagaggcttaagctttctatatagagaaaccttccacccaagggtatagaattatttaattaaatcacactatattcttgactgaactttaaaatttttctccaaacactattctgtagttatccaagctcatgtaataatcataataactctatactgtaggtacttttattatcatcatttaacagatgaggaaactgagcccagagagataaataactcacctaagaacacacagcaagtaagtagcagaacctggattaacatagtttagtccatactcttagccattatactgcctctgtatctacagtcagttactttatagtttggctgcttctatgcatgtcatcttgtttttattacattttctgatggattgttgcagatacaaagaaaatcggctgattttttttaagttgatatgtgtattgcatgatgttgttaaattctcttcttagttctaatagtctattaattttttttctttttgyatatcaactgtaaaaagtgacagttttaccttttcttttccaatgtttaaagctctcatttctttttctttccttatagcattggccgagacctccacgacaatgctacacactgtgaagtagtgattgtgagctaagactgtcacttatagaaaaatcatgtattcctagaagaaggttttcatttcatcttagctagaggacatggagcacttcaggaaactatttcacaaaaatgtaaattagaaactgtgtctggtagccaataatccatttttaacagtggccctgtgctcatctaagcaacagaaattacttttgtataggagatggcccttccaggggagaaacagctcagttgtgatacacttgtcttcatcctgactttaagtacatttaactccacactaaacccttgtggccacaacacagctctgcacctgtcatttgctctagacaaactgctaaacgcaattgtttctgacaatggattactctgtatcccgtgggggaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctsagagtccctcctgcccaccctgtgttctccatactgaataaggacttggccacaccttgtcaactcttccctctgctctactcctgacccctggatccatccttcatgctgtggctgaagggatccccccatcatgcaaattctgccacatctcccgcctaaaacccaggaagactccccactactctcagcacrgaaagtacactccttagtatggcatcccctgccctcatggcatggccccatccagccctccagcctcacaccctgcaaggacacctagacccccacctccctcaacccttcatgactgcgcttctgatccctgtttcccctkgctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgcctkgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcacccsgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggycccctgggtcagcctcccagccaccgccctcacctgccgcggccacaggtctgcatccagcggctcgccctgtgtccctgcagtgccggctcagcatgtgtccagcgcgcagtgagtactcagcccgccaggtctttggctcgctcgggtgcggaggggcggctgcttgggaagagtgggtagaaactcaagtctgcctaaggagagactggaacagcagcagccgtctcctgcaaagaggaataagaataggggtctcaccgtgtgctaaatagggcatgtctcttttcatctcgaaacagcctgatgagctatcattatgcccacttcgtagaggagaaactgaggcccagcgtgggagatttcctgctttcctgcctagggtccctcagctacaaacagaaggcagatcctagccagttctaaagtcaggcttggccgggtgcaatggctcacgcctgtaatcccagcactttgggaggccaaggcggacagatctcctgaggtcaggagttcaagaccagcctgaccaacatggtgaaaccccgtctctastaacaaatacacaaattagccgagtgtggtggtgggtgcctgtaatcccatctactcsggagtctaaggcagggaaaattgcttgaactcggaggtggaggttgcagtgagccraaatcgtgccactgcactccagtctgggccacagagtgagactccgtcttaaaaaaacaaaaaaagtcaggctttctcactccactgtttttaaaacactgggtcccaagtctgactcagccacttcaccacctggtctgggtttccctgatcaaaaacatgtaggctttctctgggtgagtgttgggttcaacacccttgtccaagctcatctctagaccctcacagggagctggcttctagccctagaatagagtggygctttgtaataactcgagtcatctctcaggtgttgaaggaaaagtgttggaaatgggttgagggaggtgggtgccaagcatgaatggatgggtgaaggtggccagaatggagggaaggtggtgcaggcaggccatccaggctgaagctcctccacctgctcctcttccttccaggcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggtgagcctttcctgtcstctccactgtggacctgcaccctccctgaggaaggggcctctgatcctcccctctggtacctgatggaactgcagagaaattgtggaagttcattagcagctgtcaacagcaggagagggaactttacaaatggcccaagtgttaaagagtcctagtgaaattgtgtctccagagaaagcaagagtagtaataaattataatgatgttggttttggctatgtctacactgagtaaagtggatatttgcagtgttcctgtagcctgccaacagagatagaattgtgtcaggtccacatggtttctctggcaccacaccactgatcaatcccggaaatagttacttgggtgcatactctgtgttggggggcaggggtacaaagatgaaatagccttgtccctcctgctgcccaccagcttctacttggtgacacagttccttcttggagcaacacatctcagggaggactatgacagtgcacatgcagccttcattttctagggaagagttacctaattttatttacagcttcgttcttttaggtttcatattttaatgtaaaaaacattgccgttaaaaactgctccagtagctactgctgcaaaggctaaaggctaatgttttaaaagatgtcctctgcctttctgctctctaggaattttttcttgagtattttctagcttgttgccttaggaatatcttaaaataarctcaatgccaccaagccttcttaaagggctcctttcccctttcaatctttcataatgtgctgtgcattgctcctcacaattcaattaatcttaattggacagggggctcaagtgaaaactgctttgtttcccgaagaaaggttcaaaatgggtaacttttaggtgcyccaattcatatagatttttttgtgcaaaagctgacacccctactcccagatatagtcctaagggtcaaaagattatagaaatcaatttaatgttttgtacatcatttgtcaaatttgctgtagtagaaaacaaatgaggtagatgcaagtgattcaccggccatatccagggcacaggtttgtagaatttgggctatatgtttattttttagtttgatgccattcaaaaaccaaacatttcaattaagatttcaaaattctagcttctcttgaaaagatctgaagaacaacactggactcacacctccaaatctaactctttataacctgctcagaatagtggggttgcccaggtctgtttaaacacctccgggaatagtgtattcatttcctactgctgctgtcacaaatgtagtgggtttaaatgacacaaatttattatcttacagctctgggcatcagaagtccaaaatgggtcctactgggctaaagtcaatgtgtcagcagagctgtagccctttctggaggctcttggggagaatctgttgccttgctttgtcaggtctagaggctgcccacattccttgacttgtggccccttccattgtccataccagcaatgtctggttgagtctttctcatgctgctccctctggacygaccttctaccygcttctacttttgaggwcactgcttacactggattcacccagataatccaggatcatctctctactcttagatcagctgattagcaaattgaatgtcatctgcaccttcattcctctttggcaggtcacatagctcattaccgggttccagggattgggagrtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccawctctaggaagctttgcttcccttcctgcccctcctcagaagcttcatgcccttctcaccatgtctcacctactgatgcctcctggtcatttgggcamttgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgygtstgtgcactgcaaattaaatctcagcttgtcttaagggtttgcatgtttgttatatccatcaractgtgaccttaacagttccccctttagaagttatacttgaaataggtattcatagaatacagtcactttagcaaaagaagaaacaattttcaccagaagcaagtgtcacagtgaggtgtrgaggctggttagcacaggctgttgacatgatttattgtgtttacataatgaaaaaatatgtaatccagagaaacatgccccaagcttagggagaggagggtgagagacagaatgtaaggaatctattttcttttgtattatgaagaaccagaatttcctgcaagtcaaagtgacagaggtcaagggcagccagccggagccttcctggcaccctggcttaccagccttgtggggtgccaggtgcattatcaatgttataaactgagtttctccttcattttttataggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaraaattcacrtttctggtatccatcattatgggattttaactggtcctacttcagaagttagatttgggagaaaaattatttttaaaaaatggttttwtttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaatgaaaagtttcagcctgtatgatgaattcatatcastgatgtctgattattttttcctctagaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctrgatcaaaacatgctggcagttattgatgagctgatgcaggtaagacttcattctatcagtgagagcacctttttcatgctaaagataaccagccagggtctttgataaagagatayaaaaagaggtctggaggccttttaaaggcctgacagacctacattttcaagaagacagccttgagggtgccgtctatagggagcacaaatgtgagcagatcacattatgaaaagcagactccaaagtattcactctgtggtatcccccacactcggcaaatgtttttgtgcattttcttatgtcagcctcaaarcaaccatatgggatctgcacaaaggagggaaccaaaccttaggagagttaaaccacttgtctgaggctctgcctcttaaaatccttcaagaggatttcactacacttaccttctcactcacctctaaaggctccaggacgtgctccaggatktgcmtgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagarcttgctttgttatgttctgaatyaccataacacagatgctaatataaaacaaatatttatataagygagggtgactgctttggtgacgaggacatgggataaaaatatggtggcagaaatcattgtctgaaaagtaattgttttacttttattcttttcgtgtgtktgtktgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtcacttaamccctctgtgcctcagtttcctccagtataaaatggggtgactttattctagctttcttttagactttttgtgaggaagatatgaaagtatttattcatcargggtgcaaatgtaaggttttatattctgttatcaaatcaaagtgctaaacttgggaaattcattgccaggtttatctgacacaaatggcatgtcttcagtaaacaggcctgttactgatagtgagttctgatcaatagcaatccatcacctccctgtgctaaacagaagtgggctttttaatgtaacatatataaaattaattagatattgcagcagatgtcattttaaaggaactgtttctttctaagacacaactcccactgatgattttttctaaatagttttaagggtcttttcagagctcattgaagatgsatgtgcttggaaaatgagtatttcttttctcattctgcctggtgatctggctgagagtagatttggattgggtttaggagtggcataagggacygagttgcaggctctgagacatgtactggcttcactcatttttatgaatgaatatttgaattttggaataccatgtaagtcatgcttactgttcattctcctaggccctgaatttcaacagtgagactrtgccacaaaaatcctcccttgaagaaccggatttttataaaactaaaatcaagctctgcatacttcttcatgctttcagaattcgggcagtgactattgayagagtgaygagctatctgaatgcttcctaaaaagcgaggtccctccaaaccgttgtcatttttataaaactttgaaatgaggaaactttgataggatgtggattaagaactagggaggggraaagaaggatgggacyattacatccacatratacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgattctgcaatttttctaatgtacttttaagtgttaaaatayacattgtgggaaaattgaaaactctgatgagacttcaacaaaattactctggaaagaatgccacaatattcttattcctttcctagtccctttcatctcattttaaagggaccctagtaagacaagatatgctttactactaaggcagccaagtgagtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctccatttgtttaaaactgtatagaacttttgcctgaaccacatggataattgccttactttggcttaagagatgtgctcttaatgagctaaatgttaaattccatctttttaattctctaaaccaggagtccccgatccccaggccatggwgtggtactggtctgtggcctgttgggcagtgggccccacagcagtaggtgagtggcmggtgagcaagtattaccacctgagctccgcctcctgtcagatcagtggcagcattagattctcataggagtgtgaaccctattgtgaactacacatgcaagggatctaggctgcatgctccttataagaatctaagtaaygcctgataataygaggtggaacagtttcatcccgaaactatctttgcccccygccccccgggtctgtggaaaaattgtcttccacaaaaccagcccctgctgcccaaaaggttgcggaccactgctgtaaatcatgtaaatcttaggtttcatgacttagttcattttgtactgctgtaacagaatatctgagactgggccatttgtaaagaacagtgatttatttttttactgctctggaggttgggaagttcragaacaaggggccaacatctgatgatggcctttgtgccccatcatcatatggcggaaggtgagagagagagcaagggggtgctgaacgtgtccctttataaggaatccactcccatgataacagcattaatccattcatgagggcagagtcctcattgcctaatcacctcgtaaaggtcccacatctttatactgttacaatggcaattaaacctcaacgtgaggckgggtgcagtggctcactcctctaatcccagcactttgggaggccgaggtgggtggatcacctgatgtcgggagtttgagaccagcctagccaacatagtgaaaccccatctctattaaaaatacaaaaattagccaggtgtggtgacgaacatctgtaatcccagctactcgggaggctgaggcaggagaatctcttgaacccgggaggcagagcttgtagtgagccragatcgcaccactgcactccagcctgggcaacagagcgagactccgtctcaaaaaaaaaaaaaaaaattcaatgtgagtttgggagggggacacaccacattcaaaccatagcaattcacctgacacartacaatttaatgttaaggctttgayaatccattcctccttaatagaaaaaggacctaaaatacaaaatattttgagtgacccctttcctcagttactcctcccaactgaatcccaatctttctccctgtaaatgtgttatctccttcccaggtcctcctgcatgrcaaacattctcgtttttcaaattcttgccctattagacattcaataaaatagaaaccatcagaagctagatcccatcacctatctccttctcttgagtgattcttccacaatcttgaatggtccacaagtgcttcacagacatgggtttctttcaagtgtygagtctggggtctcagcagctttgacagtgaggagagacgaacggggctgtagagttgcagccacccctcacttggaatggtgactactggttgtctgggcccagagatcaggagggacaagcagacggtctcttccatggactgggtttacacacaagaacacgtgtgtttcttctgttctagaaattagcatgggatatgcttcaaaaacatgactggccacagaaacagcttcatggttcattccattctttattgcatggttagtttttcactttttttaagcctgtgyctgcagtttacaagtwgtgtagtatgcttgcaaccaaatcattccaatgctccccattggtctcctcttctgaaaaaggaaggtaatactagaatctacctmaaaggatcagagaaagggtaaaatggaacaactcgtgcaaagggctagcgttgcacctggcacatagtaagtgcacaataaatgtaagcacattttgaaatgtattattagtctttgggctaagcacctgcaccraatttkttacctcctctttgctgctatttcctcattgatgaaattcagaaaacggtgggacctaattaactgtgttattgtgaagattaaatgacacaatacastgccarcacctagttattactcaacataaatttgtcacagttctcacaagacatcmgaacacccgctgatgtgctgtcccccatggcactcagcatattaagtgtggtcggcacaagcggctgcctggtgtgaagtatgagggcaaaaggcagggtctctgccttccaagaacaaagggtggagagcaaagtaacttttttttttttttgagacggagtttcacttgtcacccaagctagagtgcagtggcgcgattcggctcactgcaacctccaccctccaggttcaagcgattctcctgcctccgcctcctgagtagctgggattacacgtgtccaccaccatacctagataatttttgtatttttagagacagggtttcaccatgctggctaagctggtctcaaactcctagcctcaggtgatccacccacctcggcctctcaaagtgctgggattgcaggcatgagccactgagccaggccaggagcaaagtaacttatcaaaaccaaggaccatccccctaaaaataccccccagtcaattggagattcgtttgattaacaaactactttattcaaaagaaactaaaccttgaaagtgtatctcacacctaagaatgactaaatcagagaattaacatgaaaaatatttagttgtcmgctgccccattaaaggtccaggactttgggaagacagaacagttctaggacatggtctggccagacatccaaaggtragtattgaaaaactcaagagrtgtaaaagacccttagacacccaaaggaggataagaaactacagacaaaaagaaaagaacaccagctttgttgggggccagcacccacagccatcataagtcctcttctctgtgtcacactgggccattcagttattatccttatttgaggactaaacattttgggccgggygcggtggctcacacctgtaatcctagcactttgggaggccaaagcgggcggatcacaaggtcaagagatcaagactatcctggccaacatagtgaaaccctgtctctactaaaaatacaaaaattagttgggcatggtggtgtgtgcctgtagtcccagctactcaggaggcygaggcaggagaattgcttgaacccaggaggcggaggttgcagtgagccgatatcgcaccactgcactccagcctggcaacagagcgagattccatctaaaaaaaaaaattaaaaattaaaaaatacttttggttctggctagcataatttggcttcctagtttaaagcaaactgcattacaatatgataagtaagaaaaaaatatggccgcattgtccaaaaattgaattctatgtacttgaaatattttatttaaaaaagtgaaataggatgcgtataaatgttttgaaatatatgtggtgagaacaggcacaaaaactttagttatatttatgtatctttcaattttacattaaaaatatgagtatgaattagatctatgtaatatcaaaaacagtatattaatggaatctgttttagacaaaaaaaaagtagtagcaactgctcarttgtgcttcctaaatgccaggcatgttcctaagagtttaccacaaataaacataaccatcctaataaccctttttatggatgtggaaagtgaagaaaattattgaagttgaccaggtgcggtgactcatgcctgtaatcccagcattttggaaggccgagatgaaggattgcttgagcccaggagttcaagaccagcctgggcaacatggcaaaatccccatctctacaaaaaataaaaataataaataataagattatgtaagctcacataattaacattttaagtggcctggtctcagcctgtgccagcagctatgctcatgttgaagtcactgtctaagtcaagggaatgctttccctataaccatataaatatcatcccaattatttatgtatctcccttctctctcttgctaaactgtgggaacctcagatataggcaatgtagtattacccacgtatttgtgttcccagccccaggaacttaaaaatgatacagaaacaaagggaatcttcatgagcccccacaattctcatgtcttttcctaatctagatagaaataaagaagtctcagccaggtgtggtggctcatgcctgtaatcccagcactttggggggccgaggtgggcggaccacctgaggtcaggagttcgagaccagcctggccaacatggtgaaaccctgtctctactaaaactacaaaaattagccaggtgtggtggtgtgcgcctgtagtcccagctactcagcaggctgaggcagggaattgcttgaacccaggaggcagaggttgcagtgagctgagatcgtgccactgcactccagcctgggtgacagagcaagactccgtctcaaaaaatacataaataaaaataaaatttaaaaaataagtctctagtctttgaaagaaacttattcacaattataaaaataaagagttaaaaaattgaaaatgcatatgcttacttagttcaaaataattatacatgttcataatggggaaaaatccaaattcataaacgttttgatttagttaacataatttaaatacctgtggtctgagtatatgtctatgcttcagaaacaacgtgccaataaatattccacacctaggggtgggaaagtgttttacttcccattaggttgcagatgtcttagaaacacattcctgcaccacagcttcaagaaatccaaataatgacctgatctgctggtttccaagctaccctrccaggagcaagtcagaggccctgcagggctcctcggtaagccctcgaaatccctctcccctcaatgaccccaccacagcagctccacttttgaatattttaccagtgcgtgttccaggtaagatttcctttcacaaaaggttttcgtgggtaaggaaaaatgaaaacttgctgaattactctaagcccctctctccagttgtttttataatggaaccacctgttgatttccaggcttgctcgaaaagaaaacactgctataaatgcatagagcgtcttcccttctgaaaaggaaacttgtgctagaggttacagaaaacagcaagaatgggattgcaaagaataaaggtggctgactaactctagacttcctaactgaggacttacatcaggaccagaacaaattaggtctaaatctacagtgggctccagggtggaaatggaggtctcacttaagaagcaggagaaatctcaaaactcagmgcctagaatttaaccccagggcctccgtgttagcatcagcggctgcagagccaggatcaggacttctcaaatcctgacatatagacagggaggctgagaacacctgtcaaccaaaaacacatgattccagcagtgaatccctgggatcaagctcttcagcaagcagtgtgctggttcaccctaagaagg

SEQ ID NO: 13215 - DNA, 241805 bp, Homo sapiens
  misc_feature (1)...(241805): n = A,T,C or G, or insertion/deletion polymorphism (see Tables 1-2)
tgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttgcattcctasgtattttattctctttgaagcaattgtgaatgggmgttcactcatgatttggctctctgtttgtctgttattgatgtataggaatgcttgtgatttttgcacattgattttgtatcctgagactttgctgacgttgcttatcagctcaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagtggagagagaggacattctgtcttgtgccagttttcaaagggaatgcttccagtttttgcccattcagtatgatattggctgtgggtttgtcataaatagctcttattattttgagatacatcccatcaatacctaatttattgagattrtttagcatgaagggctgttgaattttgtcgaaggccttttctgcatctattgagataatcatgtrgtttttgtctttggttctgtttatatgctggattacatttattgatttgtgtatgttgaaccagtcttgcatcccagggatgaagtccacttgatcatggtggataagctttttgatgtgctgctggattcagtttgccagaattttattgaggatttttgcatcaatgttcatcagggatattcgtcgaaaattctctttttttttgttgtgtctctgccaggttttggtatcaggatgatgctggcctcataaaatgagttagggaggtttccctctttttctattgattggaatagtttcagaaggaatggtaccagctcctccttgtacctctggtagaatttggctgtgaatcaatctggtcctggactttttttggttggtaggctattaattattgcctcaatttcagagcctgttattggtctattcagggattcaacttcttcctggtttagtcttgggagggttacctacgtatcttaatctcaccttcaaggctgcgaaagcacgtagtacatgttcgaagaaccaagtggaggccagggtggctgaactgtcaagtaaagtttgagakattgtcaaaggcccaatcatrcaagggtttgtaggctatgctaaaaatttttcattttattgtggaaaaatggaaaagtgattgaaaggttgtaatcaggcaagtgtatggttggcataatgactaaaaaagattattctggttgcagagggagaagaattttgagaaggccatgggaacacaacaaatgtgacaagtgctgggctgagggaagtaaagagagttctgagggcatgcatatctgattttccccataacatcctctagagatacttttttcccagtccaagatccaccctagggtcatgcactgcatatttctaaactgcatatctcagcctttctttatcttttatgaccttgccatttttgaagtatacaaaatatactgcaaatactgtactttagtacttaaatgtcccttagtttggacattctaaaaaatgagaaaacattggtttgactgatgttttctcatgcttagatttggggcatgcacagtaataccacagaagtgctgctstgtccttcagagtgtgtcacaccaggaggaacatgatgtcagtttgcctcatattagttttgattgttgtgttgactttgattccttggttcaatgtagagcctattgtatttaccacatttctagcttctataaatataatgccttaatatatataggggagagagagacaggttctcactggagtgcagtgatgtgatcatagctcactgcagcctccaactcctaggctcaagcctcaagtgattctcctgcctcaacctcccaatgtgctgggattacaggcataaaccactgtgctgggcctaaacttcatgtttaacatctgtcctgcatgcacatgccatatacactttgttctagataatctgttaatatgcctgacatattagtcatcttgctttgacctcctgcttgttttataaatacaaattagtcagtcctaaacctgcttactctgccttgtctgttcctttaggtggaaaccatagtaaaggagcttgcccacacttctccccttgccctctgcttccctgtgtggtcccttgaggcaagatgtgtactccttctcttgggatctgtgaatataacaaactatattttcaatggcagttatcttttggtctgttgactttatcatatttaaataataatgaaacatattaaaatatctgacatatttttctgcttaaagtcactttttccctttttaatgaataagtaatttgtggggagatactttaaacttttttggctgagatgcatatgagaaatatattttacatggcgacacagtgtgtgtgtgtgtgtgtgtgtgtgtgtgtgtgtgtattggtttgggctcyatcctgctgagtttgaggccttaggacattggattggagctgttcagggggcagttggctctcaggaggaaactcaggaggcactcaggaggamacacacacaycacacacacacacacacacacacaagaaacagtagtgttataaakttatacatatcttttccacatgaaagttattttggtttctatgttgttatatttcatttgaatataattcttgccttgacctgctaaattgatttcattaccctctaaaaagtaattacctctgtttgcaagcactagtttgatagaactaccaagttgaattgtctggttgccaaatggaaagtagatgggagggggcaaaactgatagcaaggagctcattctaaggctctccctataatttagattgatgagtggattgataaatttgagktaacagaatttcatgattgattggcaatgggggtggaaaaaagaaggagtcaagaatgatgtaaatttcagcttggcttctggggcaatggtggtgctgaagcttcttggtttcactttcacctgtctctttcggttgactgctctgaaaagtcctatatacatatatggagagagaaatgtgaaaactaaagaaattatctttttgcattatagagaaacactgctggcttaaattgcaactgaattaacctgggctttcccagatactggtccatagatttaatcaccccaatctagtaacaggcattctcaggtatggatgccagagataaacacgtgcatggtgcaggctgttttcaaacgtcacgaattggggattgcattgagaaaatgggttattctagtggaaaagtgtgtgggtccacayacagagtgctgcgaatgatgggctgtgctccgctaggtggtcccccatccctaccccttttctgctctcctacctcccgttctccctccctcctttcccctcttctgcgttattctgggattaacggcggggtcggccccatacacaaacgcagctggctagtacggtcagcctgagccctgctgtgcaaccacgtcaggaattccagtaagttggcaacactggagcacaaagacaacaacaattgaggaactcttcagtacagaaaggaatgtttggagccctggctgctacagtgaaagggcacacacacacacacacacacacacacacacacacacacacacacacacacacacacacgctcgcgcctgcgcgcccacgggcgcactggagggagcccagcccctcccgcactcgcgctcctccctcccgccagccggcggccgctctttgtaagtcggaggtgcggggacgctcattgactatgcagcgcggccccagcgggcgtcggaccggcttgaccccggcgcggtctcgtaccatcgcctcggccgcccggaaccggcataaatcacccgcgaagactggagtgcagcatcaagccccctcgccgcctccctcctcccgctccggtccggtcgccccctccctccccagaccccrgctctcctgtccccagtcctgtctcctccgcgccgcacagcgcccaacactatgcagggaggcaaatagagaaccagtgactttggccagagcacagacctctggatttcccaatccaggaatctctcccactctttcccacaacgctgcccgctccacctttttttctttaagcctaagttttctctttttgtgtctatttatctctttttgtctttccraagtaacacctatcctttccctcccctagcccccacacctaaagctgcgcctaccactgcagcccacggaagctacgcgatccggactgttggggtcagcagagccccggacgacctgtgccccggggaaaggggctggcagtaattggcaggttctcgcccctggggaagggaggcagcgggaacctgtccagcgaccacgtgcgttcagggctgtctcctccatgcgtcacggccccttcgctggagggaaagggctcctgacttcttggaccaggatccggagcctgggactagctgccgcgctggttcaggggctggagctggagatgatgggatggcctcaggcccgcaaacagccccttctcacacagggttcccaccaccgggaaataacttgcatcaaccctccttttttwcccctccctgtgggctctgatgtcacgtacaggctgaggacgtgcgctgagggcgggtgtaaggccacttgtgcttttggcttccgggccccttgccagcctgtccaaagcggccccaaagaagggaggctaggggttccctgaacctctcgtgtttctccytcttataaaagggtaccggaaccatggagaagacgttcgctctttttcaattttgcttcaaaatgagcagacttgtaagaagcacgatctggccatgacacctgtagatgtggtgctgaataattgctaaayaaggatccaacctccccaacaaagatccacctccctctctaatttgtaaaaacacaaagcaccccatctcagcagcctgtatcctatcaggggaaaccaagatatccgaaggagcctagagagatcaggccaggaatgaaggtcacagatctccatccagcaggctctttactccttcccttccctacccccgcctctttccctttctttctctttccttcatttttacttgtctggttgtgctttccttttccatttcttattttttctttctcttctctattcttgactttcctcctcgtccatttctttccattgctcatttagtaaaactgcgtccgtgcagatttccccgtgagccgcctcgccggcttctgtgcggggcaaaccctgcggagaggcgagggcagcgcgtgtgcacgtgtgagtgtgcctgtgagagtgtgcgcacaggagtgtgctcttgtatgcacgcgtaaaggggactgtgtatgtcggcgttgaagtgtgactgtggaatgtgcgcgcgtgtgtgactggcgtgtatgagtgaatctgtgtcagttggtgtgacacttaggagtgcatgcgcctgtatgagtgcgtgtgtgagtgtgcacacgcctgtgtgagtgtccctgtgtgagcacgcgtgtgttcgagtgcccactcctccccgcgctgcaaagtgcagggggcgggccgggcggcagggggcctgcccgctggattcccgcatgcttgttccggggcggtcgggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcsccggccagtggccaaggtaagarcccagccrgagcctctcgtggagcccccacttccccggctgtggcagggtcgggtccgcgggaggccggaggggagagcgtccgggcaggggctagggccgggcggcggcgcgggagctgctcccggtggggcgctcaggttgcttcgcgaagccggagsgggmgcgcccctcttcgctcrccaggaactgagcggcagcaaacttgagaaagcagccccgccagtttcggtgacagcgcaccccacggagaccctgtctttgttcccacgggcgttggtccgatgctcctrgaaagcactttgcgggagaacgaggttctccgccgtttgcagcctgccctccctagcggagttctctgctgggcggcgcggtcccgggctctgctcagagcgcagctttccacctgcagcgcccctcccgggatcccttcgcgcgcccagggccgcgggccagagcactcctcccaccaccggcgaaacttggtcccgcggtgacccccagagaccgctctcaccatacagatcatttacgagccaagataaggccgggaggtgggattggccgagagagtggctgagggactggagtcttttcttgaagttttcctttccagctgggagctgggggcttttgtgttgatgaatggggcccgtctgcatggccagagttttggggatcgaatgcagaaagtttctagtatgaagtgctttaaacttctctcaagttgtccgatagtttatgttttaacagaaacagagaagagggaaagagagggagaaagaagcggagagaataaaactagtaagaagggaagaggagagagcgtaagagaagcaaataggaataaggaaagaaggagggaagagaacgactggggcgggagaagagagagagagaggasagagaggagagagacagasagagagagagagagagagagagagagagagagagagagasagagagagacagagagagacagagagagacagagagacagagacccggccgaggatgaatgggaagggcgaggaggaggctggaaccggcgagctctccccctggctttgcgttgctaggtagcagccgggagctgcgtgtgaccgaccaccagacagacagaggggacgctgctgccaccgcagggactaatctgtctgtggggatgggagagtcccccctttcccctcctgctccttccctcccgtcggacaacttaattgccctacaatgaaaatgaaacccctattgttgtaggattagccaaagcaataaattgattttcctggatcacatattggggttgatgggtggggaatgtggaagcccccatttacggaggagtgaggggagggcttgtggatgggccgtggcatgtattcaaatggttaatctgctttctttcctcaattcttagcgtaagctccttagagggaatcaagtaagtaattatacagcaactcctagcagcacccatttcagacttcctgggaagaagtttggaaaccctaacaaaccccacaggtcttgcaaaagtcttcagaaaggcaggagaggcaaggagagatcattaataaccttcctttgaacaccctttctcagtgttggtaacgcagaaagagggtttattattattgtgcagagtttgcacaatgcttagggttgtatctcatgtcctaaatatagctataggatttactatatgttcctgtcagtgcctggcaaaaggaaatcttaccttgattcatctatgtccttgtacaaccaaaacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatrcttattgactcaattaatcttcataatatcccttggaagtaagtactcttattatcactgttttacagatgagaaagtggaggcacagaacaattcagtaatttgtctcagttcatactgctagaaaatggcaaactcaagggattctgaattcagagtctataattgctacagtatacagtgtctggttttctctctctctctctctttttttttttttttttttttttgagagagacagaatctcgctctgtcacccaggctggagtgcagtggtgcaatctcggctcactgcaacctctgcctcccaggttcaagcgatcctcacacctcagcctcccaagtagctgggactacaagcccggggcaccatgcccagctaatattttgtatttttagtagaggcagggttttgctatgttggccaggccagtcttgaactcctgacctcaagtgatctgcccgcctaggcctcccaaagtgctaggattacaggtgtgagccactgcacctggcccgatttctcttttttcttttgtacaaaaaatgtcatgctccctaacttactgtccatgtttgaggttcccaaagaagctgagggrcaatatgcaactcgtaccacctgctgcttcataactgtggatctttttccagaatctctcctcaggtttctaagaccagaacccaagtctccccattcccagtcttcctacttgatcattttaagacgcatttcctctgaatgtcctctgcctgatacgttgagatttctagaatcctgttgtaatgatcctgacttaatatatgaagtaaaatccaatgagattgtaacagcctttatttaagcactaccttttaggtaggctaccattgcaaacttcgcatcactaaaaattggaggggaaaaaaaagagctctgagtattctatgtttagtctttgaaaaaaattataccacatctgttgttaaaaattatttgcattttccttatcttttgtgtaatgcttttcaagaaaaaacattttgcagagtctgaactcgagtcaagctgttgggttccaacattggctttaccactttctagctgtgtgaccttgggaaagtcaaccaactttgcatagctcagatggcttatctgcaaaattgacaagataataagagaatttacccaatgacatcttgtaagcataaagagataaaatatgccaagtgcttagcatggtgtaaagcatatagacagtgaaaataaactagaaaataatctaaaaatayaatatttttattatatttatcaacccttaaagtaacatattgttttgcttcctattcctatttccatttccaattttcaaatatacaaaggaaagtcttctttaagcatttttcactaacagttctctgaagacttctcagaccctagcatgtgattggaagattttttcytttttttttttttttttgagaaaatcgtattggccttaaacaaagttgtattctgtttactaattaaaaaaacttatttttcaaaaatagaaatggggtctcactgtgttgcccaggctggtcttgaactcttggcctcaaatgatcctcctacctctgcttcccaaagtgctgacattayaggcaggagccaccttacctggtccaacattatattctttaatccaataaaaatgtggtaatgtttttaagagttagtatcagcttttatgacaattacatcttcacatgaagtttatatgtttaaaaggattgtgggggcaatagcaaacttgtatcgtttttattccatcacaactctggaacctcactgctgctttaatttcacagttgttggcttctctttctctacttgaaaaagtttctctttaccagtcttcataagacttctgcctgaactcccttcagtcatgcacctgtctcattttaatagaaactcagactttttacagctagagggaaccttagatatcaactggtctgcttgcattttttttttcttacagataagcaattagcccaggagggagaagaaaggggctgagaggatgaaagggaaggcggttaataggtttcttgcctaaggacatctagcctgtgayagagctaagatataaatttgcagtggaccattttttagattcatgccttctgaatgtccccagcctgtttggttggttgagatttctagattccttttggaatcctgacttgccagataaggcacagtctgataagcagatgaatcttaaaaacaattggatgggttacctgtccctggccaaagaggaatcctgtgataggttattacaaccatgtaccatgcgctttcagcttggtccagaactgatgccatgtcagtgcccctactcccaaagaccatacctccagatccatttttcaaattcttgagccatcaaagygcattcctgaagatctttgggttttgtagtgcaggctgctgtaagactaggttttcagtcttactaaaggtaattattaggtcataatcattgttcatgttctctagtcaggcactgtaagaacactgaaaggtttttaaaatatttaaattaaaattttaaattatcatttaaaaataatgataccaggaacctagatgtatttcctgtgtaatcagaagcaagtgcattgtcatattggctttggagtttctgttaagtcctagtagctagaacaaggtaagtagaaagtagaaggtgctgagctgggcgtgggggctcatgcctgtaatcccagcactttgggatgctgaggcgggaggatcatgaggtcaggagatcgagacctgcctggccaacatggtgaaaccctgtttctatttaaaacacaaaaattagctgggcgtggtgacgcacacctgtaatcccagctactcgggaggctgaggcaggagaactgcttgaacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatggataggaaaggggttctcaaggttgactgcasgaatctagagcaactaaaaaaatactaattgtgaagccctattctagcatggaaaaaataagcttgatggaacctttggtataaatcaaatggttctatcgtatcctattaactttatagtcttgagtaattaaaaatttttaccactattgtgtattctgtgaatgtttattttattttttccatgaatatttattaaatatcaacagtgtgctgatgagtcaatagtatcaatactacagaaacattaaggaagatgagaactgaaaagaggtgtctacatatctcrcaattaaaatggactgcagttttgcatttaagattctgaaatagtcattgactcattcctaataaccctgcccaggatctcaccagcattagaaagaytggagatgtttcagcatccgagttctgggatgcttcttgataatgatcagctagtagttgttttgaaatgtcaagagcatttctgtggttcttcacatgttcctaatgcaaatgtttccgaagtaatttcttgacagttacagtgttttgagatgaagtgggaagggcttgtgattttraagttggaggatcttggtttgattcctacctctgccatttattatctgggaaatccagtaccacacatgctgggtgctctggggcagttttcttatctgtaaaatggacatatatctacctcacggggtggttatgcaaaggcaatgaatgtgaaatgtttaataaactgtgaagtctcatatagatttccattcatcattattacccaatacgagaattttactttttccaaacttgagaggaggaagatgttgcagtattttggtatcttctttaccgtgggtctgagaatgatgcacctgtgcatgttgttacatccttacagtggctaccacaacttcacatgttattcagtactgttatgttggtgaatgtcacaaaactaagttaaactgtctgaggcaaaaaaggaaggttattgaaatacatagttgaggctgggtgtggtggctcatgcctataaatctcagcactttgggagtctgaggtgagcggattgcttgagcctaggagtttgagaccagcctgggcaacayagtgagactccatctctacaaaaaatacaaaaaattagccaggaatggtggwgtgcccttgtggtcccagctacttgggaggctgaggtgagatgatcgcttgagcccaggaggtcgaggctacagtgagctgtgatcaygccactgcactccagcctcagcgacakagtgagaccctgtctcaaagaaaataaatacatagttgaaaagatacagataattaggttgatccatttgagattgattttttttcctatgcagaaatagtcaaatattggcaatttcatttggttcaacctaatataaaatggaggctcaaactatgtcaggccaatcttgtcttttttccgtctcctggctctgagatgactccattcttaaacatgttctcctttgatgtaaagcggctgtcagtggctctggagccacctcctatcagatcacatccactgggaaagaaaaagagtttttatcttagctattcccagcaaaagtttcagttgcatctcagggtctctacttaggtcataaactcattggagaaccaaccactgaatcccgggtcatgatgtgttcccatggcttaggcttgggctgtatactcagtctttgagatcatgtatgaaggggtggagtccagagagaaatgggggtaattattgggagaatggtgaacagaggctgggatgcaaaaataacaggtgttcagtataccttatcagataaaattgactgacgatgttattttcattttgtatgtgaagacacacttgaaaaagctacagaaatttctcaagagctggcagccctggggtaacttacagaattgaaaggaataaagtattggaaacattaagaaaaaagacatggtgatctgtgcccatgtgaccatgttgcaactttaagtttagaaggagaacaggagaaagaaggacttttagaaggtttatttggatcctaaagttttcttatttggagcagagctttgtgatagacaggaaagttctggaaaatgagctgagcgatcagactacaggatcccttaagtcykgtgcagtatttcatttttctgtgaatcttaggctcctactccttttccaatttacttcactccaatgtttatgttcctaagagtttgtctgttttccaagcactagtcctttgctataaggatggggtagagagaaagaagcttaaagagtttgcagacaggttaagatgcttytgtggagacagaacacatcttggtgcacatctgagtgtccttagcacttcatctatggacttctttcataaatggtagaacacgtatccatcacaccttattggattaattcagaaatgccagatatatgtactctttgctgatggttactttkttggtctctaatttaagtcttatctctaatcacattagctgagaaaatggagacattatcattctaaaaataagatggttaacttttatattaggacacttctgatttaggatagcactgaaattcagtgcaaagaaatgtaagtctttcctagataatgacagattagacaatttgaagtttcacttttggtcattagccctcaggtcatgcctgacctcaaggttactggaaacagtgagaaatgaatgaaaggaggaaatgtaattaccattctgtgcattgaatagttgagccactgttaccatggatacaatggcgcatttattgtccagatcttgagatccaagtttgtaagcaatatccaaggtctcctttaaatttatgtactatcagcgaataacacatgaagattcctggtaactttgaaaataagtctttcctcactgatctactgattcacattaagtaagagcatgtgtacttttgaaggtgttgaggaaacctgaaaaagacgaaaaggaaagtagctacacttctgttatgctggacattcttggattcctctataaaaatattctgtcttatactgtcagtgatttgcttgtcactttgggcccagttctttggtttttatgtcattaacaaggagaaaatttcctgagtaaaggttgaaaaaatcaaaatcgtttatttttattttttgagacaaggtcttactttatcacccaggccagagagggtctcactttatcactcaggctggagtgcatggctccctgcagcctcaacttcccaggctgaagagatcctctccgcttaaccccacaagaagctgggactacagacacataccascactcacagttaatttttatattttttgtagagatgaggtttctccatgttgttcaggctggcctcaaacccctgagctcaagtgatsctcccgcctcagcttcccaaagtgctgggattataggcgctagccaccatgcccggctgaaatcatttattttgtcaggaaattcttaaagttgaatttaagaatgaaagtattttatcagaaatatggcaatcctacccacattttaatctcactagaaggggggtgatacatgctagcawgtactyccacactgrtttaattttgatgtgrggaagggtgtggagaatactttttgttgcaagaaacagaaaacccaactcaaaatggcctacacaataaagggtatttcttggcttatgtgagtaaaaaatactgaggcagagtggggttcaggcgaggtgcagtcagggctccagttctctttctttgtgttttccttgaccctactcccccctaagtttcacctttgtgtgcggtctggcttcccatatgattctratatggctgccagggcaaatggggctacgtgtttccttgatcctatccagggggaatccaactttgagaaggttttagttatgttctcaaaagtattatttcatcacaataacttacagattgttagaatttctaaggaccctagacaaagtcagctagctccccaaacttgrcatatcatcaaaatcacctgaggaacttaaaaaagtatagagattcttaaatcaaaactcacccttactaaagcaggggtatgaaaatctgtgtkttttaaaaattttattttattttactttcagttctgggatacatatgcagaatgtgcaggtttgttacataggtatacatgtgccatggtggtttgctgtacctatcaacctttcatctaggttttaaggctcacatgcattaggtatttgtcctaatgctctcccttcccttggcccccaccccctgacaggccccggtgtgtgatgttcccctctctgtgtgtgatgttccccccccgtgaccatgtgttctcattgttcatctcccacttatgagtgagaacatgcggtgtttggttttctgttcctatgttagtttgctgagaatgatggcttccagcgtcattcatgtccctgcaaatgacatgaactcattcctttttatggctgcatattattccatggtgcatatgtgccacaaccaacccaaatgcccatcagtgatagactagataaagaaaatgtggaaaatctgtatttttaaaagtttcaaggtgattctgagggctggaccaatttttgggaacgtgtgatctaggtaccctctcatttttcagttttgtaaacagacttagaggtgaactgacttamcactgcaaatttcttcagtggcagttaaatatactctgttaaatctctttcttttggatgggaatgttacaagctagctacaacaagaaggacaggactcttttaagtctgagggtgacatgaagtactaccctcattcctggccacctccttttttggccagcrtggcaggtcctgaacctctccctaaatatgccactgtttgtgtcttaattgtatgttttgttcttaccttggtcacctttgaagttccccccagaccctcctaagaacrttggattcattgaggtaaataactgttgcaggycttctaatcttttctcacctgaatctgaattcatctcagaacacccctgacacagcccactggcttctagagaagctgtctgttccatgcttggaatggaagtattgaaaaacttcatggctcatttcctttgtatcccagcctcaactctttgttgacctcattgggacttacagtttgttgatcctaccgcctcttcaccatccctcaaatccctcacctatttacttcctcagcttatattttatggccatcattaatttcacttccctgcatacatacrcgctcagcagcttggcccctttatctggctctgttgtgcttggcaaggccctgatcctggttaaatccagttctccacatctgcaactctgtagctaaacatggcaggagaaaaacacaactatactgactagcctcgcttgacattcatgaagccaatctcaagcttargacttgcttcctagtctgtctattgcctctcttgcttccttatatcttctcctctttcctcaaacctctgacatcaccttctcacatgtagagtgagctttttaaaactgtgaaaatggaagcaaccagaaragaattccataaacttctataactcaaccatcatcatttgaacttcgkcttatatcttctgtctttcctcctattactctggaagaattttcccagttcttaagtccaaccatttcattcatgttctagatctcattccctctcacctctctgcaattgtcccctctttcttttatgaaatcctctrttccacattaccttctaactatcactctattttttcggttccactttacagtaaaattcttgtacagatgtgcctatatccactgtaattacctttcaattttttctcaaatccatgccattttgctttagccctcatccttgatagatatttttttggtcaaagtcactcatgasttccatgttgttaaatccaatgatctattttcagctctggtccttatttaactggttagcagcatcacacacagtgtatccwgacttcctccttgaaacacttagttagattttcaagaaactgccttctcctggtttcttttcttccttgctggcctacccttggtatctcatgcttgttcctgtctatatccctgacctgttttcatctctagctacactgcctccttggtggcctcatcctgtctcatggccctctttgaagcagggagtggtttcccaattcagggaggcggcatggactckggtggaaagaacatcacatgtcaagtcaggacattcatggatcttgttcctgaagaaagaaggaaaaataggcacaaccaaagagggccccaggctgctgaaaaggacccagggccacttgtcctctggggatagtctctgtcatctgagtccccactttttttttttttttttttttttgcgatggagtctcgctctgtcacccaggctggagtgcagaggcgtgatcttggctcactgcaacctctgcctcccaggttcaagcgattctcctgcctcagcctcccaagtaaactgggattacaggtgcacaccaccatgcctggctaatttttgtatttttgtagagatggggttttgccatgctgktcaggctggtctcaaactcctgacctcaagtcatcctcctccctcggcctctcaaattacaggcatgaaccactgtgcctggcctcagtccccatacttttgaggactccatatatacttctttaccatgtacatgctgacaactttcaaatttatgaatctaatccagaccactaccctatagtctagacccacatatccaactgctcatttgacatgtccacctggctggccaatagtcatctcagacttcacatgtctgaaattgaactyctgatctccactaatgtccaaacttgctttccatgtggaatttctcatctcagcaaatggcttcctcatccttgctcaagcctcaaactgtatcctactttgacttttcttttgctcctctaccccatatagaattccttaraaaatcccattgttttgatcttcaaaatacatctagaatccaactacttttcaccatcttcacttctgccaccctgattcaaccractgccctctcttgcctcgacgattgcaatggcttccatactgatttccttgctgtagcaacttttttagaacatcagtcagatcacagcacccctctgctcagaagctcccatggtttctgtcatactcaagttgggttgcccaaaaacagacactgagatggagcttggagtatataatatttattaagatcaatgcgtgtgaagggaaagggaggaagcaggatgggcagaagaagaagttgaactctggcagctgttggtcaacccagaggaagctctggagcaagagttgcctgttagagtgtcctatgtcaggctgaaatggccttgcttaatcactggatgtggcctgtcctggaaggacacgaccttgggcaggtggctttctatagctgaggcagaccccaaaggagctgattgcaggaagaaagtccttcctcatagctggtccttcctataaggggaagctgcatggcacawctctgggtgtaccactgcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataaggtatgtaacttagttagttgtttgtttatttccttacttattatcttcccttccctaagatgtaaatggcacaagggcagggattttcatctcttttatccattgctttccctagtgtccagaaaagggctaaataaatgaatatacattgaataaatgaatggacagatgtcaccatgggtgctaagaaggggcatcctcagctcatcaccattccctggtactaccagcccttaattcctcgaggcccctggaggcccagtcarggtcctgatggagaaaaaggaaaattgctgtctctatcaaagcaagtggcttagcaacgctgtttctctcgatcygactccccccttttctccaccccagtgcctcccactcccrccctgctggtgattcccaatgcatttgagtagttgaatctgcatccttctttttaacttccatcccagatacttggttaccctgtgagaattcccctgtacatacagaatgggtcattctgctatttttaggacagatttgatacagtagcttttacaaaaagataagccaaagtttttagacwtcrtgttagtggactgtcattctgtatttaaacagaacacaaaagaaagctgtctgagaccatgacacagtgaaaacagccttgatcaaacaaaaggccctctttgaagaggggagtggtttctccactcagggaggcagcatggattgtggtggaaagaacatcacatgtcaaktcaggacattcatgggtcttgttcctgatgaatgaaggaaaaatgggcacagacgaagagggcccctgactgctgaaaaggacccatggccacttgtctcctggrcatagtctccctcatctcagtccccattcttttgaggactccatamgtaacaaataggttggaggcaggagartgatggaattccacacatagatgagtagagaagttgggaaataagccacaataaaagtgactaaattatttgagtgctttctataccaggcattggcctaagtgttttgtaggtattagtttacctacttaygtagtaacagtaaaaattttatggataaaggaccaagacaatgacaggtgaggtaatttgcccaaagcaattcagttactaagtggcagagccaacatttgaacccagaacccttatttgtatatgttgtcaccatggataatttggagcaagtggaagatagtcctctgtacgtaatcaaatgaagcctcatttaatttctcatattatgatcagatgacctcatttcagaggctggtaccattgcgacccaacttttggacatttttttgctactcttggcagttcattcattcattcattcattcaatatatgttgcagccttatcatgctctaggcgtgatgtaactaggtactgcagagtatagacagagaccttcaacataggccacatccaaaacaacttactattgaacagagtatatttccacttccttctagaagactagaagactgtactttttaggtacggattgatttctctctgctgggtttctcctatattactatttcattatctgggaacaccttttttttttttccctctataattatgtgtcttttaattcaaaggacccttacctaatcagagagttcaattttaaccttccgttagggacagcagtcatctataaattttcagaggttgttgttgtttactactaatgaaaaaaattattaagttctcttatttaaagtcactgaagaaaaaaatgaacaaccaagtgagagctgagtttctttacttcccggagaacactgctgttgtagagatggagragacatttcctatgtgctggatgtgcttaaaggtctcttggtcccaaagtatctctcactacggccaaagatctctgctctgtcattactaaagtcagttcttcggagtaagacattctttcctcctgaaactcctattacaatgtggaaatgttcactcctgtagggtaaagtagttagttgagatagtaatgcacagtaaatgtttgtcagagcaaggttcagagagaaggagacacaaagctggtatgttttaatggggatgaaagagggaaagaaggtactagaggtgtgatatagtcttgaaaataagccaacttccttttctggggaataaagggttattatgcttgtgctttttcttagaatggctttatggggaatttcagctgtgrtctattaggaaggcctcaaagatagaacttaaaagcttctagtatggctgtccttcctctagttagcaattgaaactgagttgttacaacaaaaggaaaagttgtcgttaaaagcaacacagttgcaagactccatcaaccattccttggggattcatcagtgcctggtaagtttgagaagagacccttggattttaatatacatggcagttataatttgtctagaccataatgattactattaatagggaatcctgtttttctatttttaaaaaaatttagagatgggggtctcactatgttgcccaggctggattcaaactcctaggctcaagtaaccctcctgcctcagcctcctgartagctgggactaaggtgtgtgccactgtgcctagctctgtttttctttaaagttactgtgtaataaaaaaagaatttgcaaatgcataaaattgaatatacacatgtcccaagtcaattgtcaaatgattggtttttatgtaccaaaattctgcatttttttttcaaggtcacttctgatataagaatttacttcttccctaatatttggttcagtgaagtgttgaaagaatttgctaagtaatcattgaaagctaagattctagtgaaamacaaaatgcatggtttaaaaattgaacrtactaactgaaagacagtggaagttagatgcttcttgctgtaaataattaaacccaacagtgcagacgagagaacatggcaccaagagggacttgggctaagaaggatcatattgtattgaacactttcgtttccctgtaagggaaatcaaaagggtctttaatagttgttgctgattgtgaatatgtgcaacaaaatcccactgtaatccagatttatttttcaagcattttgctgtgattgaaggaaggagaaagggataggaagaggatggagttttattaaagctgtagttacttcttccctttaggaggtctaagtgtgacttgtcacagtgacctgggactttgattccctccagggccttcctgttctatgggcacattggtggatcaaagacaattgacttttgttttgttttgttttgttttgtttttggagagaagcagtggttctgctaactcagaacaagaacgacaagagtcatgtaggatgtttttctgagtttctctaacagtgctcgtttttttttttttttttgaccgccccctcttttccttttgaggtggggccaaggggtcaaacctccatttttctatctgtaaaaaagagaatcggcctttatgaagtgctttaattttaaaaattaacataggctaaaattgctgtgtgtgtgcacagttctgtaaatgttagtgcatgtatatatttgtgtagccacaacctcattcgggattagaacagttcaatcacccccactaactcccttgtgctactcctttgtggccacaccctcccaataaagtgtgttttaagttccttttttgaaaactgaccttcccagatgaatgtctctgttgccttttatttgttcatttttatttacgcagtgttccttgctcatttttgaagtaattcaaaatgacactcacggtaagcttgcaagrctgcctttcctttaytataacggagaaaaaattctggaaagaaggcagctctttcagtatagtcatataagaacaaaatttccccaaacttggcttgtggctagattggaatccgtaaagaaaacacactcaagaaatctctcttgaagaggaggacagaggtttattttttatttaacgatttaccccttgacacctgggaaatgattagttgatgttttcaaagaagattaagtcagtgtgrttaattaactgtggtaatcaggtgacttaaatcaattaactccttgttaacaatttccatcaattttgtaaataaatgactaaatcagtaaattgtactcttaagattaaaggctattttctgatttatttttttgatgacaaattagagtgtttccttctcatctcagtcactscctgccactcttgctcttaatcataagccagttttagtttgagaggagcacaccagggaaacttttaatatatggttttaaggaaaagtcaggcttaaggacacctttgctccttcatctcagcacatttggaaagaatgatttagtgagagcagtagttgggggtgggtgtagaaagcaatcctgaaacacactctaggataagcttttattattaagtcacttaatgtcttgttttatttatgttttctaagttaaaactcgatgagggatataataaaatgaaacagggtttggctcttagctaaaaataaactttaatggatgtcttacatgctctatttagagggaatttcacaaaatattgggatatattgactgcattcatttgtaaagcttgattgcattaaaaataccatacaaatatacaactaaaatgttgttactttttagaatctttataattgaaaattctcttccctgcttacataactttattatgtctttgtctccaatgaaatatgagctggataaactaacacaagaacagaaaaccaaacatcacaggttctcactcataagtgggagttgaacaatgagaacacatggacacagggaggggagcatcacacactggggcctgctgggggttggggggctaggggagggatagcattaggagaaatacctagtgtagatgacgggttgatgggtgcagcaaaccaccatggcatgtgcatgcttatgtaacaaacctgcacgttctgcacatgtaccccagaacttaaagtataataataataaaaaaagaaagaaatatgagctggaaaattataaaaccatatcctatgcccctgaatatgccattgcattctctgaggattttcactgtaggacagatgatataggtttatttatggtttcttcaagaagggatatttggcatcttgaataacttttgaggagttagtaaatatttatgtatttgcaaaaattctatgctattctcacattttataaagagaaaatttctatggcttcctttaaggtattaaggatagattaaattgtgaaactgagctgaagccactgttgtaaatttaaatcactggctgccaagcaaaattctgggctcttcctattattatagaagctttctggccataccccaactaccccttcccaacttccctggacatagttaacctgtggccaaaccctttctggtactgggacatggtctggaatcacagctcagagatttagctcgactgctttccagatgtgtacctctgaagctctctgagcttcagtttcctggactatacaatgggtgttagtaatttctaccttataggtacctgggaatatttaaaggatattgtgaacatgcaaggtcctggcacttggtgagcattcagtaaacatttggccccacagggaacctgatattaaatcattcatagttgaccagctcttggttaggtcatgcagcaaagcagccaccatgctgtgattttttgaaataaagaaaccacttgtcaaattctctatccatagaaattgctggggaaaaatacagctttttaaagcagatgaaactactagacaaaaaaatgttggaagacaggcctggtcacctgcctttcttcccccaagaatgtttggttcttcacctcccaggtcttgaaggcacagatccaaatgtaaagttgccaagaagttcaaacgttggtggacctggtgtttccattttaggtgtcctgtgcatgctttctgtaacttggttttatgcagaacttgctgatgatgtctctgtaactctgagaacaggaatgatggaagcatgggtctgagtggaggtcagatgtgtcctctgggcaaggagaaggatttgcccagggaagactacacttgaagaggagcacttgattttgtgagaggttttagacagagcatgtaagaatcacagtcaatgaagagttttctctcttgcaaaagttccttattatttcatgaaactacagaaaggtcagtgagatgttcaataggtgagaaagctgtcaagctagacttggttaataattacagttaaaataatcactgatgtatttctttcacrcacgtttattgcaagctttttttttatcaggaactgacatgcatagatgaataagacatgcaaataaacaattgtgctacagggtgagaggtctataatagaagtttgggagcacagaaaaggcagtgatgtagtcaactagacctgagaggaccaagggccaaggaagaccgcacagattgccatttgaactgagtcttgaaggagttgggagagtggactgtggaggattttgtatgtcaagctaagaagtttggtgcctttgaagaaatgtaagctgggaagtacaatgctcagattttcattttgtaaaaagaatacttgctgcaatgagagaaagcagatgaactagttaagttagaggattactgggattatctgggtgacagatgatgagggtagaactagacttgtgcacttggaagtgatgagaaaaggagagagtcaccatggaacaaagagaaagcttttatttgttgccgtttttgataattcttgttatttgttttataagttggcatgttttatttatgggaatattagacatgtcttttcaatgtatgtgtatgttaattacattcataaatattcaactttttttttttttttaattttcctgcctgaaaaatttccagcttgctgtctgtctgggcatagcgtgtgacattttctttgttttagttcactgattcctagttggttcatctccctcagggaacctttggaaacatatagtagcattttttgattgtcacaatgcctgagtatccctgccagcatttagagggcagaggacaggaatgctaaaccgttgcaatacacaggatagttccatactacaaagaattgtctgggcttaaatgccaatagttcttttgttgagggcccatcttggttgataggaagtgaatagagaggcagaaagggatgctattggtaataagagcggtcatacactgaaacttattatatgcctgatatatagtcaccatagctatagcatttgttcttgtgacactccagggaggtagataccattactattccctttttactaatgagtgaactgaggcagagtaggatatttggctctgggcctcacatacttaactctaatactctgtttttccacatgctttactttcttgtaactttaaattaataataagaggaaaaggagaaccacacttgctttgtgctttacagtttgttaaatatcagaatatacctcctggaaacatttctgccagtttagtagaatattgacaagttatcgcctccaagcatttttaaaaatatggaaaatatttgatgaaatttttttaaaattaggatgcctttgtagattggaagaaactcttatttgatggaaaaacagttggtgctccataaatgcctggggaattgaattgactctggaggcacttagtgtctttagagggtgtcaaagatcttgcaaatttattttaattttaattttaatttttttttacttcacataaaagagaatctgcctcacgtatgatctttgtaatttgaagacgtgccagtgacattgatgaagaatgtgactttttcttggacatgccttgcacttccctgtttctgtgccagttctagtttgtttcctctgtgaggcrtcccctcccctcagatccatctatctgtagcttaaatgcacctttctctacaggacctttcttgatatccactgaatgttatctgaacctctcttacagcatgtctcctcatgccatgagatacaatcatttgtgtatgtattttatctcttcctctagaagagtaccaccttttgggagaggcatagaacaggaccactgatgctaagagtatgcctagctcctctggtctcttgtgtctggcacagtgtcaggcataagcatgcactcaagaaatttttgtttaatagaaagtcaaaagaacagcatgtgttatagtaaascaactccatcatggtggggaggtaataggcatgctctactctgggctcctgtcgcagagaggattttgtttggcttgaacaagacaaacatttaattctctcttacataaccagcagtggaaggctggtctggtggttccatgataccattagagacacaggctccacagtcctctgctggtgactcccattcctgaagtcacctcattgtccaaaatggctgctgtagccatagccatcctttctctatgccaggtagtgggattgcagaaggagaaaggaggacatgccttctctgtttaaaggagactttccagaagtcccacacaacactactgcttgcatttgatctcatcgattaagrcttagtcctatgatcacatttggctgaagtttggaaaatgtagctttttagctcagcacatagttcacctgagtaacactgggttctattactgaggagagagaggcaaatgaatgttaaagtatgccatgactgctcctggccaaagctggtcgggtgacactgcacatcttctcttcagctttgaataccacattttgggagaggcatagaaaatttgaaccttatttgaaagagagaaacaagaatgatgagaaaactggaaacaatattatgggggaatgatggaaaaactggagatgtttcttttggacaagagaataggggaacaatggttagctctccaaatatttgaggaactattatatgaagaaggataaaacttactctaaatgactctaagagatgggaaagaaattgtagatatatcgtatgcaccaaaagaatgctggaatttgactttagggtcacttttaacctttgaccttatatagtacagatgcataccatatagatgtatccataagtttgtgcttttgaggttaaaatattrcttattctctggttacttcatattggaattctctttactgagggttgctatggtgataacacccttagcagtctgcattttgaaaagctttggacttttccttttgtgagatgtggtctctatgtttcccccatgcttggcgtttttcaaaatatcatcaagtcagaaacaatttccaaatttatcagagtgaagtgaggagaattttaaaattgtagatactaataacaggggttagtaattctatattgtacaactcagtgattcaataaatattgtcactatcaacttctttggattaagatagctatgtttaggcaactggttagtgttatttagttaagcatgtattttttaattattactaaatttcttaaacacccttgaaatataattgttgaaaatgtcttaaaaacacagctagtatcaaccagagaaataatttagcaaagagttaatttatttcactaagtagtgatatatttttgaaygcatgtggaatagatgtgtgcctataaacttgactttgtgaattaagttttatttttctagttcagttttactttgaatatggatatgttgttgttttgtgaatcttagacatcagaaagatttagttgggaagagaagtaataatgtaaaataaaagtaataataaaatactcaaatttctgtattaaattagcttttgggggaattagctacataattaggttattttaatagattttcaaactgggttgcagatgatgaatatagaagagctatatatatacataaactctcatataagcaaatatataagaagcaaaaaaaaaaccctgtagaattgagagggagacaatatttggagtttaaaggatcagaaaacactggcctaaaaatagtatcagtaatcaatttttattaaacacttactgatatgccagacccataatcctcactctaccctcatattaatgttatgagtaagagctcttattatctccgtttttagatgaggaaactgaggcacagaaattaaaatggctgtcagatagttagtaagaggtggagcagtggtttgaatccctagtatatgactagaaggacttcaccctggacagttacttggcttctaagcagtcttcgcgtgctcttccccttccttgcccttctgtaatattatagtagtttcccagtagtatgcagcatctggctattcagactttgtctcttaaccttctgtggaaaagctgttgacttttagacatgctgggcagaatggaagaaggaaaatacagactgttatacttggagaaataatgatttcatatgtaacagtagttgaatcaataggtggacaaatttattgaaacttcttgagttaatccagtgatggtaaacaaacacatggccaaatgagcactctataaagcatgccttctggaatgcatattgtcttgtcttgtctttttccttccttccttccttcctttcctccctccgtcttcctccttttttcttttcttttcttttctttctttctttctttctttctttctttctttctttctttccttctttctttccttctttctttctctgtctctcttacattctatctttctttctttcttccttccttttttctttctttctttctctttctttctttgtttttctttctcccttcccttcccttccctccttccttccttcttcctttcttttctttcttttctttctctctttctttctttcctctcctcccctactccctctcttcctccttccctacttccccccatttctttttctctttcttttgctctgggtttgctctgtcagtcaggctggagtgcagtgcagtggcatgatcatagctcactgtagcttcaaactcccgggygcaagcgatcctcccacctcagcctcctgaatagctaggactacaggtgtgcaccatcacacctggttaatttgttttgtttttgtagatactggctctcactatgttgcccagggtggtctcaaactcctgggctcaagcgatcctcctgcctcagcctcccaaagtgttgggattataggcgtgagctaccttacctggcctcaagtctgtttcttgatcagtaagcctggtaatattgggctgtcttgtgtgcatatatgtagatgtacatgcatgcatacacatatattccactttgggtggaatggatgaatcttttgtttccagtggaaggagttctttgagttacaaatagtagaataagggctttcagtttaaacagaacccacatgagtgtttcattaatcatgttcacgtgttaatggattctcttgaggcctttggagtcattgyttttgcaatatttccttagggcctttttcttcagtccagattaatctaaaatacattgcactgatccagagatgtcaccaaattctcctgaaaagccctttgactgtatttgggctggcctgtgcttttatggaaaaatgctatctcactgctgatgaggtttctggcattagcaaagatggccttatacatggtaccacaacctatgtggtacgatgttaggagccctgataagatactctgttcccctacaatctgctccatcaagccrgtgaggaaggtatgtaggcattaggaatgcctaaaatgccacaattagaaaattcattccttggagggcttctgttttctgctgaaagtgcaaacacccgtagaaggctttaagaatctctcaaaccttcccgtgaataagttcacctgggagcagatttttggggtcagggtcgtgagccatggaaactctggccatgtcatggggatctgagggagagagaaggagaggatttttagacagcggtgggggaagtcaggcggaggtgggaccatttaactagataaggctctaatcgtctcattcctggactatcagaacagccttttaagtttaagttgcttttccctctttgtaaccttacccaccaaactttgtgaagtgttgagtgcttatagtaaacagagtgaacataactcttcccagggaagaactggctgactttagtttcttggtttctggaaggagatgggatagttttattggcttgcttgaggatagccaaacggttgtggacaagagggcttgtttcctgacaagtgttattctgccttaagaatacaaagataaatggtctaccagagcttcagtacctgtttgttgcgttgcatttagtttggagtgtttgctctgtgcagtggagaatactttggagggtggtaaggtctctctgtttcattactggaaaagaataggagtggggtcatggcaatggggtatttcattcctctgtgcgtgtgtgtgtgtgtgtgtgtgtgtgtgtgtgatggagtcttgctctgtcacccaggctggggtgtagtagtccaatctcagctcactgcagcctctgcctsctggtttcaagtgattctcctgcctcagcctcctgagtagctgggattacaggtgcatgccaccgcgcctggctaatttttttgtattttcagtacagatggggtttcaccatgttgcccaggctggtgttgaactcctgacctccagtgatccaactgcctcagcctcccaaagtgctgggattacaggcatgagccactgcgcctggcctcattccttcgtttgcaggggctggatgtctaggtttatggaaatctattctcattcaaacagaaatagggtaacaacttaagataataaagtttttctttgaatgaattagaaaggcattattgtatgttattttagtcaaataatatttttgcatttattgcattcttctgttatataagagaaagtttagagaattaggatagtgaatacttttaatgcttgttttttttttttttttgagatgaagtctcacttagtcacccaggctggagtgcaatggcactatcttggctcactgcaacttctgcctcctgggttcaggagattctcccagctcagcctcycaagtagctgggactacaggtgcatgccaccatgcctggctaattttttgtatttttagtagggatggggttttgccatgctggccaggctggtcttgaactcctgacttcaagtgatccacccaccttggcctcccaaagtgctgggattacgggagtaatccaccacacctggcctttcatgcttttaggaaaaatttgaaattcttttaaacrtgggtcctggagaatcgctgaacttcctttttttttcttctattgagacagaatttctctctgctgtctatgctgattacagactcctgagcttaagagatcctcctgctatggcctcccaaagtgctggggttacaggcatgggctactgtgctggccaaactttttgaatggaaaactttttagcttggtttcagttgattaatcctcaatttctttatgtccttaattctatggcttatgccaaggcatgagttgaggtcaacagaaatccttttatgatgatagaaagataacgatgtccaagtttaatgtacagtataatgacttaaggtcaattctgggaaagcctgtatgtttatcatcaatttctttttggtgatggaattatacacctacagtatttcatgtaaaactccagaggatcacctgaaatatgaatgatttacaatggacaaaataataaaaatgctcatcgtaggaaaatacaaaaatatataaacaagaaaataaacataaaaatgcataaacaagaaaatagcaagttgggagcaagcttgcttttgactctagtttgacctgtgtttctcagaataaatcttgattttcactcttgcccttgaccgaagactgggccagtggaggcaaccaccaccatctgtgctttcagtgttgagcatcctaccaagcaaggtggcttagattttgaaagttttctctcagtcagatagtaggggaacaactcttagaatgttagaattagatgagtagtgggaatgccctggaaggaaccacccttcatggagggacggctgtgcttcaggcattgtgccagaggtttacagggacctctttaatcctcaccgtaacctgattttgcaggtcagaaattttgtaggtaagaaaactgcatactgtatcagtttaaattcaggttcatcaagctaaaccagttcagtaacaaatatttattgagtgaaggttcagtggtaaatgagacacaaacagttcctgccctcatggaacttagagtttggaatgacacagggacagtcagtgctttgccagagttgaaagccatgcatctcttggctttctggcgattgctttttccattggtattcttattttagccattcttactgaatttaatttaaattttacttaattattataatgcctatggatccatgttctgcatattagctcactcatactcatccaagactgtaactatrggtacccaacacccagaattgagatggccactgaaaactctatncttgaccaacactctaatatcattttattttctttaattgcctttgtaagaagtataatacaaacaaaactccagtaagcaaatggctttaattatttgtgtgtcagttagtagagattttattgtatatattttctggtatagtttattactgaagccgtacttctttttagcattaaaattctaaaattttatrtttataatagtgacaaaggtttttactgtaattactaatgatatttaaaacacagattaggcaaaatcttaggaaatataccctgctttttttccttccatttctggcaatcactgcagataaacttgtaattttattcatgttgctattaatatggggacattataaattcatcatgtctgtgcagaaacctgaacaccactttatcacacgtgggtatcagttggtgacaatgtaatattgttgattctgtgtcaacaagctattgaattgtttcaagtcatcacaatcacattataacgtgaagtgataacattgacagagcctgaaagtggtttggagacctcctcatgctatttgagcccaggcataacaaaccagggccaaaggactcctggtgcaaagataacctgctggtgaggcatgttctgaagttctttttgctcagtctgttaaaagcaatccagtaggggagacacaggaaatttaaggtcattctaccatgagagtatttgcaaatataataggtccttctttacagatttacaaggcaatgatttggcattacatttgtttctctatagggaaattaaaatcatgattatgctatattagcaaattgcttataaaacaaattacaatttttgattgtaggataagawgtactcttgtagccccctccctccctccctccctcccttccttccttccttcgttccttccttccttccttttcttccttccctccttccttccttgtagatctctttgwcatcttttggacatcatcttagtttcacacatatattctaacacatcatatatagytcgtttattgagggtaggctgggtactaggaggtcctgtaacaggccctgggaatacagaggtcgcttagtctcatctgttctgttccttatatttcacatatccaggtcgtggcaggagaattttgaactttctgcttataaaatcatttccaaggcataacttgtcactaaaggggaaaaatacaaaaatattgtgtaaaacatcagcaaaaccagtttttaaaaaagagaatgacatattacatttttattaaaaatgttgacttcagtttactagatgattaattatcagtacttactgcccaagaaaaggcttttaaacttattgttggaaatcttttggcactcttgctgcacaatatttcttaatagtttaagaaaattcttactctgttggcagaagccatacatgcccatcactaaatggtcaaggtcgaggcatgcctgtgtgtgcaactcagttattcatctaacgaatgaactgtgaataaagtttagtgtttgtgtgaataacaatgcaatgagcctcaccatcaccaagcataaacatttctgataagagttgtcatcagagttgcttattgatgttgaagcattggtttcgttagagtaaattatgtatatatatgtgtatgtgcatgtacgtatgtgtgtgtatatatatatgtatmtacctgatctctactttctgaaaatttacacatttagaatgggaggttatttagttcctagcatgtaacttgtgacttataaacccacttarcaattacatactgcttcaatctgaatttgggccatagctaaataagggtgagttgccattttgtaccaaattgaggttaaggtgcaagatgccaggtgtcatttaaaccaaggctaggatgcaagatgctaggtctcatgaaatttagtgtctggacactgattgctaaccttgacatctctcctttctgccctctttttctctgtctccctttttctttttctccctatttttgcctcttctctctcttctcgtttctttagagcttgttgttactattgcgatagtcaagaactaaataatatggagttagggagaaggaatacagcaaggtgtttataagattcagtcaagaaggtccatttagtagttataaataatttagcctatgactatggggaattaccaaatctaccaattgagagtcaatttcttctcttcttgttgctattgtcataatttgcagtatccaactattgttcacttgataacctggtgatctcatctgattattaagatgaccaaaatgaaagtgatgtttatagctttaacatatccatgtcagtttgatttatggttcaacacttggacctaattaatcaggaaaaccctaatttgatgctgtctatcaatgctagtctgaaacaccattcaaaagccttaagcaagaaagctgcctttctaaagtctctcttgtcatttatttctcatgaatgtccattttcttttttagtgtttgattccactcaaccattttccagtaatttatattgctaatcaaaaagccgtataggaattctctgggtgactgggactggaaatgtgctctgaaatgggaatgatttgtagtttttgcacagggtgtgtcaaatcatgaggtgctgaagggcatgttattcttstaagtagtttgattcattgggtccttatttacctgggcaggcaggccatcttaaattttcttctgtttggatagtgttcttttcaacatcctgtaagtgtagctcttttaccatgaaagatgtaaataaccagttagtctctagtggggattggggccagaggagaagaaagtcttgagcttagtttccttccacgtgtagggaaggttcctctccaggaacctcagtgacttarctgatagaggaggcactgcatgagstattyagggggagcacagaaaagactggtacaaatacactttcagtgctttgatgctggctaacaggaagttttcattgctcagcgttcttggtaaaaacttggacattcttttgaatgtttgagcgcttaagtgattgtcaatttatatttttaattttttgtgaatgtatgcagttgggatggggagaggacatttggagaaattatttttttgctctgataatgaatacggacgggaaaagtttgcaccacaacgcagaggtgcttatgactgtttttcatagccacaatcctttacattaatgatgaactacttgaggatttcagatgcttgtgtttttctagtgtggtcccctccccttgaaggggtagacctgtggacgtgtgatggaatggagcattccagggtgaaacaggccttcctggaaattagattctttatcactctcccaggggagttcatttcaagttgctggtactagcagctgcagcgtgagattgcccaatcctaggtgctcttattgatgggtgggaaggagtgggattgctgtttaagaaattttattatctttagaagggaagaatgtattatgttttttttttttagatgatctctttcatgtgggctaagataattttgagctctgactgtccaagctgcttagaggttctgagttgttctccactgggggtggtactgccactctcaagcggcatagatgtgcctgggagtgtttttgtcaccgtgatgtgggggagcactactggtgttccacaggtgggggtcagggatgatgtacatactgctttgaccaggacagttctgcaagatgagtaattgtcccaccccaaatggcgatagygtcctctgaagaacctctgagaagtgtggctttgcttatamtgttctgtagtgctgatggactgcctgattgtagaggtgagaggtgcataatgaaaaaacaagtgggatgtaagagccttgggggagaaagacaggtgactagtgtttaaatggaaatggagaagggtagctcagttataaatggctcagtttaaatctctcattgctcagaattgagaggctgctcaagtagtacatctcattctgctgccatttggttattggaaaggcactttattttaattactaagcaaatatttaagtaatctttgagatcaactatcttgagagctgactggattctgtggcctggatactcagaaacatccagcttggagaggatggtgggggctggtcactaggatgttgttggcaatgccctaaggcagcggtccccaagctttttggcaccagggactggtttcgtggaagacaatttttccatggacagcagggtggtggtgggggagggatggtttcgggatgacactgtttcacctcagattatcaggcattagattctcataaggaatgcacaacctagatccctctcatgtgcagtttacaacagggtttgtgctcctatgggaatctaatgcagccactcatctgacaggaggyggagctcaggcactaatgctcactcacccgcctctcacctgctsctgtgtagcctggttcctagcaggccacggaccagtaccagtttgtagcccagggactggggacccctccctcatggaacctgttcgtagtttgccatgcaagcggacctgctttggatgcttctggggcagctggaggggctgcaaggtgagacccttctctgctagcagcctcttgcctgcacctaccagcctgctcactgggctcagggttggggtgaggttctggggattgaagtggagctccaagctcttttcatggtcaaagtctgtatgctagttcaggctttacctactcagagtgatcttcacttttaatgcagttattgtctgagtaatcaccctcatactcatttgacaggcactctttggcttggcactgaaagctctttttctccatcttctcagccttgttgcctaccactctccaagaggtcatcactgcttgggtcatacttattagaccctcacccatgctaagcttctgtcaagtttttgttcttttttttcttagagacaggtttcaccatgttggccaggctggtcttgaactcctggcctcaagtgatctgcctggcatggcctcccaaagtgctgggattacaggcgtgagtgatcacgcctggcctgtcaagttgttttgaccctacacacaaagcctggtctccctcttcaccttcccaaatcctgctcattcacaaagacccagtgtagtcttataattctttgtgaagacttctctgatgacaccggcctgtagtgttatttttttcgccaaagtcagttagtttttattatctccattgcttatttggaaccaaattgtctgttgtcagaggcatagctttggaatcagactgcctcagtgtaaatctgtgctccactacctactagctgtgagatttgttcaagccttgtcgtcctcatctatgaaatggggccattgatamcatctcacaaagctgttgtgaggatatgtaaggtaatgcatgggaagcacttaaaatattgctggcaagttctgggtgaacaaatgctgtcatttgctttgcaggacatgaaatgatgaaataagtacaggctctggagtcacacaggtcctggggctaaatcagacttcgacattttctacctttgtggcccttgggggagttggttaatgtcactgaggctcaggttccccttctattaaataagtataaatctcacatcatacagttctgagaggatccagtggatatgtataaagctttatatattgtataacacatagtaggtactcagtaaacaatatcagctgttgttattgcatggatatttaatttataacatataaatcacttttgcccccaataaacttataggctctgtcaaaaaaggaccatatctttttatttatttatttatttatttctttttttttctttttttttttytttttttttttatccckgcccgttctcaatgagctgttgggtacacctcccagacgaggtggtggctgggcaraggggctcctcacttcctagtaggggtggccgggcagaggcgcccctcacctcccggacggggcgtctggccgggyggggggctgacccccccacctccctcccggacggggcggctggccgggcggggcgctgacccccccacctccctcccggacggggcggctggccgggcggggcgctgacccccccacctccctcccggacggggcggctggcccggcagaggggctcctcacttcccagtaggggcggctgggcagaggcgcccctcacctcctggacagggcggctggctgggcggggggctgaccccacctccctcccggacggggcggctggccgggcagggggctgacccccccccacctccctcccggacgtggggctaacccccccacctccctcccggacggggcggctggccgggcggggggctgacgcccccacctccctcctggacggggcggctggccgggcggggggctgacccccccacctcccttcccggacggggcggctggctgggcagaggggctcctcacttcccagtaggggcggccgggcagaggcgcccctcacctcccagacggggcggctggccgggcggggggctgacccccccacctccctcccggacggggcggctggccgggcggggtgctgatccccccacctccctcccggatgggtcggctggccgggagggggctgagccccccacctccctcccggacggggtggctggcccggcagaggggctcctcacttcccagtaggggcagctgggcagaggcgcccctcacctcccggatggggcggctggccgggcggggggctgaccccacctccctcccggacggggcggctggccgggcggggggctgacccccccacctccctcccagacggggcggctggccgggcggggtgctgatccccccacctccctcccggacggggtggctggcccggcagaggggctcctcacttcccagtaggggcggctgggcagaggcgcccctcacctcccggatggggcggctggccgggcggggggctgaccccacctccctcccagacggggcggctggccgggcggggggctgacccccccacctccctcccggacgtggggctgacccccccacctccctcccggatggggcggctggccaggcggggggctgacccccccacctccctcctggacggggcggctggccgggcggggggctgacccccccacctccctcccggatggggcggctggccgggcggggggctgacccccccacctccctcccggactgggcggctgccgggcggagacgctcctcacttcccagacggggtggctgccgggcggaggggctcctcacttctcagatggggcggatgctgggtggagggtctcctcacttctcagacggggcggctgggcagagacgctcctcacctcccagacggggtcgccgccgggcagaggcactcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcagccaggcagaggggctcctcacgtcccagacgatgggcggccaggcagagacgctcctcacttcccagacggggtggtggccgggcagaggctgcaatctcggcactttgggaggccaaggcaggcggctgggagatggaggttgtagcgagctgagatcacgccactgtactccagcctgggcaccattgagcactgagtgaaccagactccgtctgcaatcccggcacctcgggaggccaaggctggcggatcactcgcggttaggagctggagaccagcccggccaacacagtgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgtggaaagagagggagagggagaccgagagggagaggggagaggggagaggggagaggggagaggggagagggggagggagagggagagggagagggagagggagagggagaggcagagcaaaaaaggaccatatcttatttttcttttttcttccactgatcctaggacaattgcatatagtagttatgaatttatttgtggctttagtgaatctggcatcatattcttttggtccttatttatttattcatttatttttgcacttaaatgatgtgtctacatgataatgcatcaatttgcattgtgggttttgtccccaaatctttgacttcttgaaatgtccttatagtattgttttgctctaagaaaacatcagggctctgaatcaataattgggacaaagcagtctattcagtggtttgtaaactggattaaaaaaaaaacccaaaagaattcctgccacctatttgatgatctgtaaggaaaaccagacagttaaaatgttgcacagaaagagactagcaggttggtttgctgttcctgtcttgtttcagtttcattaactgaatccttgactattctatcaatttgacactagacagggtagagtgctccatacaatttgttacccttggctatcatcactatagtgtaaagttttggaaataagcaggtgactctaaatcttcaaaaggggactggccttgtttatgtgggcaaggtatgggaattgtagtgaactgtcagccaacttatgaatatcagaaggatgtctatccataccaaaggaatcaaaattaagtatagaaaaagtgaagcaaaaattatggataagttaaggaattgcctcttaaatttgtttgtttctttgagttcagtgaaggtggaactattaaaatgtgatttactcatacaaatttttaaaaagaggactgtacctcctcaggtagaccaagtgtttggaaggaccagcatgtgttaagaggatctagcggggaaataggatttgccacagaaattaccttactctgttaactttggacaatgttccattgactaccacttgtctttgtcttataagaatagaattkatggaaggagaaagaaacttacaaggaacgggtaaaagaatgaaactgctattaatatgactcaatgtttttttctttctttttttttttttttgaaaaaaacttctagatattccccttttttcagattattccagattccatttttctttctatggatttaagatggtaaatttctatttaaagtctcattgtttgctctgatagctttctatatctctgatatataatggtctcagcaggctgagttttacaaagagaattctacacttcctgacgaacatgcattagctattccataagcacccggtgctgtgccagaggctgtaaatgacacagaggaatgctctcaatccagygttgttccttgctgtggaaaacaaacaggcaaatgactyctcttctctgggcgctatctgttactctaatatcttatcttaacacattcttagtccaacacttacccaggaagcttgggatatggctacttatgaagaaaggattactctttttttttttttttcccctagctttgggctctttatgaggttggaaaacaagtttattcctatgtctaataaaattttactaccgatttcaaaacgcttaaattttttttgcattgctttcaattgctgcaatttttcctaagcccaataattttttaatgctatgttagtcaccaagtaaactactctttttctccaactgaagtatataagcactatggattctatgccagcccaataatgaactcaattaatgttaattgagagcagctttgggggaaaaaaatcagatttttacattcattcttgagtttagtggaataaacttttttttttggtgaaagggaacatagagtagtggtcaagtagcacgaatgctggaatcagagctgtcagattcaaatccttgctttgcacatatttgctgttggatcttgggcaagttaccgaattgctctgtgcttcaatttatttatttgtaaaatattcataataacagtatctatttcatagggttattatgaggattaaatgagctaatgttggcagagcacttagaatggtgtgtgccatttaagtgctatatgagtacttcttttcatctttgcaccatctattctgattgatgggacagacaggggctagtgctggagagatagggtgttcatttggttccgatggttcctttgtgatgattgcctggttcttaacaaaaggtttttatttcaatgtggattgtattttcctcctttcctccttggtttttactagagggattttttttttttttaatcaggcagcccccaaaccagagaggctcctggagaatgttttaaagttacataaatgattatttgcaagattacttcttggctaaaactggattggttgaatgtggcagttttgagactattttctgaacaaagttttaaagctggytctatgtagattttttttttctccctgtgggtggctccaatgtatgaaatcatccccttagctttttttttttttaaatcttcaaataaataacaaaatgtagataatatctagataaaacttttggagggcttgtgagtaaaggctacttatttaaaacaaaacactcaaaataaattgcatatagactaattgaagtaaggggcacctgcaattgttattagacctaatctagaccttttcactagtggtttatttttggtttatttttaaacaacacatattccctttatgagagaatgagcttcygaggccagtgaagcattttggctgatggctgagaggtcacccagcaatgataaagtatcagtttgttttttctggagagatatttccaaacaatagtcgtttgggagttataaacaggcatcgaagttamtactgaaaaggtgaatttgacaaatgaattatagatctgttgataaattgagtaaattggatttgatatattagataatggagtgaggagatcaagtgtgaaaatcactacctataaaaattasttaattgcaacatttccccatcagtttcatttttcatatgtgtgattttaaataattgactttgaagtgttttataaaatgacttttgrgtctctattttgtgttcttttcatgatgtgtttaacttggtattttagtttggcaaaaacaaacaaatccccccaccccactcctcaaaaatgggacttgtaataaaagttgcttaagaaatagcattaattatatatattttcaaaacaggcaatatatattgttctgataatttcctcctaaatactcagtctctaaatttatatttttcttttctccatagcaatatgaaactgtctgtaagaggactgttctttatgattgttataatttttcaaccagaagatactacctttacaacctcagatactaagggagacaaatgtactgaacttacaaatgtattatgttggattactaacaatagacctaattgataaaagtgatttaatatatgttgtgttaatagctaaacctccaaagcccctaatctcccatggaaatattgctttgtagaacaaaatccaatgagaagttctgggattccagagtgaatttgtacattccttaggggcatttttgcaagggaggttgttgtgttttaaaggtagttgataagagacctgcaccaccaaccccagacctrcaccaccaaccaccatcatgcattagtctatagaaggtatttgggtgtacgtactcctgtaccactcggtaccaccatttagccaagcgaagtttctgaccatttgcagcatacattataaatcaggatgtcactaccagacaatcagatttgaacattccatgaacaaagtagcctatataccctagaaatagatcacttaactatgtttatgtcatgctgttgatatgcctgcatttacacaaatcaggatagcacattgcttatttattttaggagtaggtacttgatctgtatatttacctaattttggttaattagccaaaaattgaaatgggtaatttagcatgattgcttaaatacatggggaagatataattattcttccaactgcaaaaatttctcctttatcccttgggtttgtgaaagaataaaataattttgagtcttctctaagtggggctggtagtggctgctttctttgaaaaatttttctatgtggcacataatgcttgggaaggtcactggccaggtatttggggaactttgtcccttggggagacctaggaaaatcacaggatatattagttcagtgaagtgagcttgtttaagttatattgtccttccagtatcactagggactatcactgccacttggggtgtcaacttttggtgtcaagtttgtatactcttgttggctgcagagattttgttttgttttgtttttggctctttggtttaaaaaaaattgtttgcagagatgagcttatagatctggcaagttataatttaatttttaaaaattaagacaaaatattagtctgaatctaagaatgaaaggccataacttgctatatatgatttagtaataaaaaatcacttaaaaaataaggtgaggaactcaagaaagtatagtcaagcaaatgaaaagttactcacgatgttatcaatcagagataaccactgttaacattctggtcttttttacgctttttttttttttgcatatgtaactctgttatcagtaaaaatttacgtccttgtttttgttacattaaattataagtatttctctaagtacttagaatttctccataaccattttttaagttactaatatgtcaatataaagatgtaaacaaatttaatccttttattgttggacatttaggaggtttgcaacttcctttgttataaataatgttgcgatgaaaatctttatacataaatctttgtctacttctttgattagttccttaggaaaaaaatccttgaagtaaaagtactaaattaaagatcaagtatttttaaaaagcaagatacgtgttgtcaaactgctttcccaatgagttccatcaagatacacactaatcaactgtgtatgaaaatcactttcttcccacggatgttcaaataaatatttttatattatcattgggagaatgtttacctaattttctaatttgcatttctttgattatctaattagttgaataatttttcattttatcaaaaatttatatttcttcggttaaatatctgcatggcataagtttttaaaatttctgtctattattgcagaatgtgacagtgcgcattttcgctgtggaagtgggcattgcatccctgcagactggaggtgtgatgggaccaaagactgttcagatgacgcggatgaaattggctgcggtaagtgaggaggggccaggctaarttctattttgagtaacctaagtgcttcctggtgatttcagctgtaacaaagagaagagctatgccttttagtgacagagccaggtctgggcccaagtcttttgagatctgtgtggttgaatagagaactgatggcattaacaataatttcactcccttctgaggtaggggttcaattcacattgatgatagagyatcagtttctatctcacccttatcccttgaccacaactttgatatggaaacatatttgggtgcagttttctggagtctgtaggtgattatttctaatattcactctgtaaattttgtgtacccacaagaacaaacaaaaaataatgttatctgaactactgtgatttgtaagtcaaagaggagtccatttttatgtaaaggatgtagaataacttgtgtcaattaccataaagaaatcacagaattggttagtgtgatttatgttttttaaaaattctagttttaaaaaatttgaaaaatacgataatgtagtaaacttcaaatctaattaattataaaatgactttcacattcattttktcatttagttttctcactaatcttctgaggtcggtttcagattagtaaattgagactcggagaagttaagtcatttattaaagttcttacagttggtaagtctatgcacagatcccattgctcttcccaacttcccataggtgatcaatcatacatctgcaatttccttcatcccagcaggtgaactaatgagggttatctttcaaaaatcaggaaagcaggtgaaaaatttttgttttgaattgttggccatgttatggcataccatagcagtcaaactttggtgtgtcatttagatgacaacgcatttgaaaatgggaggaagggtaaggatggggttctgtacagtgctcctcaaatactcatgcacaaatggatcacccaggagctcattaaagtgcaaatttagattccatattttgaggtgggacctcagcttctgcgtttctataaacttcctgatgatgttgatgctgctagtttgtggactgcactttgaacaagggactaaactatatttgtagagacacaatcatgtgctaactatttgcctcctctgggcttactgagttcattttgattaaacaataaaagcaaaaaggcaagggcagtgtatctggggtaaaggaataagtgaacagctatgccaacarctcttcagagattgttacctgtattatattttattgacctgtaaaaataataacaataacaacaatatcaatgacgatagtgatagcaagtaacattacatggcgctttcacatacattatttaacttatttttcacaacaaacagtgagatgagtatagtccccattttatgatgcatacattgaggttcagagaacctgccaaagatcttaaaggaagtaaatcatggaaataataattatttgattttgggttttctttcccaaatctcatgaattttccagttcatcatgatactttactattagttattatgaaacaaatagtttaacagtaactcacagttaatgtttacttgaatgaagcttttaatctaatacctttatcataatttttttgtgtgtatgtgtgctgtttgttttattctctgtgtttttaagttgctttggttcatgagtttgttgtgatgctgttgctgagcttatttgacagtgaactctgactggcgtccacagactctagtrtaagggttgtttactatttgccttcaaataaattgagcaggagtttacatgatacactcttctggaacaagcattgcttgctagtataatggggaggatgattgccataatgagtcctcttttggtttgttttagctgttgtgacctgccagcagggctatttcaagtgccagagtgagggacaatgcatccccarctcctgggtgtgtgaccaagatcaagactgtgatgatggctcagatgaacrtcaagattgctgtaagtgtttggagaggaatcttgctttggctttgtggacacctaaaacccaacctgtcgcaaagaagttacacacaatgggatgattctttataaatgtggagcagggccttaaatcataagggaacctatgccagcaatctcattcaggggttggatgatrttgaaagtacggatgtactgaagaattatgaatataccccagcaatttggaagtgagataggttcccaatctttaattttgattatgttatgctcaagaaaggaaccaaatatttattggagtgtatagctgggtgtcttcatgtgtgtggttgacagctgaatgagtcctttggctctgtggcatactttgtattcaaaccttccactccttctgccccaatattaaattctcttctttttgactgagtggaagtaggtaggtttgttggagggcttcttggtggttacttcagtgactgctgccacagccaccatagggagagcttgaacaagaaagaaaatagtagcgatgaagcggatcttggcaactgcggcatccctggacrttgagggggtttggttcagtaacctggaaaaaacctttaaattctaatttctttggaatcagactggaaaagactgttttaataggtctaacaataattttattttatttattttwattttattattatttttagagtcagggtctcactctctcacccaggctggagtgcagtggtgcgatcacagctcactgcagcctcaaacaccggggctcaggtaatcctcctgcttaagcctcctgagtagctgggactataggtgtgcaccaccatgcccagctaatttttaaattttttgtagagacacgatcttgttacgttkcccaggctggtctgraatcctgggctaaagtgatcctcctgccttggcctcccaaaatkttgggattataggcatgacccccccatgactggcctgaaaataattttagatgagaagtaatgttgggtaaatataagatggcgacctatgagcaatttgtctatcacatgtatcattccattcctttctctattaaggatatttgtataatttaaaatcattcttgtatcattgtggatgtttttggctgcaaggaaagaaaacacaactcaaaaaagttaaacaaaaaggggatttattatctcacataataagaagcctaactatagggttgttccagggttgattaattcccagctcagaaatattatccagctttttctcacttttttgctctgccatatttatcctattggcctttcttgattgcataaaagctgctcaagtctcaaaatttgcatcctgaaggcctgacattctctcaggcagagaggaggttcttaatagatagatactaaatgcataaatgatgggttgttcatctttaggctatatagttttgagtctattttctcttactcctctcacagagtgggaagaaagctgagctttattttgcgattcaatgtgtggtggatgaccctttgctaataataatactttacagaggggattggaactactaagggcaactgcttgggaaaagagactggagataagtttatagcagtcattttaaaacaatattgcatatcattttaaatgactatacatttcatgaggcaattctcccatttttaatgatataaaaattctccattagatatcttttaaccacaaacaaaatatgccacctctgtattcactaaagttaccagataactcctgattgccaatgggcacttytccttccttctcacactggatgggcrtttagattgcacttgactctggagaccattcctccttcttgacaccactcccttggctgccatgactcccagcagtcctggctctcttttgagctgctttggtcattccattttattttcctcttctactcagcccttgagtattggtgttgctcagagccctgccctgagcagcttttctcattctggacactctcaggatagtctcaccattctcatgactttagtgaccctctgtggcctgatgagacttaaatctgtgtttacaacccagatttttgcccacacttgagtcttgtatastcaactacctttggacctctgcaagttgccttgaactcaaggtgtcmcaactgaaaataatcatcttccctcctgaactggattttccttctatatttgctagtctacatattttatctttattaatagaaatagcatttaacccactatgaggcactggcagaaaatacaaaatcagtcttaaactattggaaataggcagatggaggctctcttacttgttgaatttgtgaaacatatttcataatgaaagtattttattagatgaagaagaaagattgctgtaagtgacaggaaagatataatcaattaacatgaaaaggctatcacaatcccctaggcacccacgctagaaacttggaggttattcttgattccttcctctttttcactgcccacattgaatcaccaactcctgcctaatttgcctcataaatatttctaaagttaatctcttcatttctctctcttttatttttattttttggcaaggacagattttttttttttttgagacagggtcttgctctgttgcccaggctggaatgcagtggtgcaatcatggctcactgtagccttgacctcctgggctcaaatggtcctcccacttctcagcctccagagtagctgggactacgggcgcatggcaccatacctggctaattttgkattttttttttttttttttttttttgtagagatggggttttcccatgttgcccaggctggtctccaactcctggcctgaagtgatccacccaccttggccycccaagtgctggratgataggtgtsagccaccatgtctgacccatctctttatttctgctcccactgccaacatctctcatttgggtgtcagcagtagtctctgggttggcctccctgcctccagttctgtggatccttarattctctctgacactgatgctgatctaactaarattctttggtagctctccattaattccaggagaaagttccaattccctaacacggtttacagtggcttccaagatgtgactagtgcttattttcctatgtctatcatttgctattcttgccttgaagtggccacttgggcacagcagtgcttttagttcctgtgggtgtgccatgctgtgtcctagccttttgtctccgtgcaagctggctgaatgctgaatgctcggttctagacagtccttctttgcttttggcctacctgactgctgcttctttaagacccagggaggtgtcactttttcaaggaaactgtccccatccatgctcccatcccagagtgaattaagttcctggattgatggttctatcattcctgtgtgcctataatccactttcataattgttttctaattactccttagtgtcccctagaagactatgagcttcttgagggtagggattgtgccttattcatttgcagatccccatattgctatactgtgtggtacattataggccctcaacagatgtttgtgtaattaatgaatagatgaatctcagcattagataggttgatggaattatataattttaatttgtttgctctctacatttgaatgagcttttaattgcttcttcgtaagccctttgaaaacctaagcacaacatttagaattatttgggcttgacgtaaasaagaaagccaaggtaattgaaygagcactgatacctgacccaggttcttttcatattttgtttgagacaacccatgacttgccttctcgggaataaaagaaagttctttaattttatgtgaaaattggcaatatatacttaaataaattatttggaaatttaatgaggaagtattaatctctttaacctttttcagataaaattgtgtctctgccatgggcagaattcagacacttaagtgccttctggaaaaatctatctattctgcctttattaatagaagtaaaattggacccacaggtataaggtacttagagaaaataygaaattatttagtgttagaagtaggctgacttgaaaaattttgtttgctgttccagaattataagacaccrttttgctaattaaacagaaagaaggaacaaaatgacaaggaagatataatcaattaagcatggagaagggtgttaattatggttttataattattatatcttatcacatgataatttctatatgtttgaattttcaagtaccacctygaaaactgtcactgtctacttatcttttacatatttttttttttttagagacaggggtcttgctttgctgcccaggctggagtgcagtggcatgattatagctcactctaactacataaaaagagaagttttttttggctcaagtgatcctcctacctcagccttccaaatagctacgactacagctacttggaagtgagccactgtgcccagctaaatttwwttttttttyyttttaagatataaggatctcactatgttgcccaggctagtcttgaattcttggcctcaagtgatcttcttgcctcaatctcccatagctgggattaaaggcacgagccactgtgccaggtttacttgtcgtttgaaaaggtttttcatgttaagttttgggggtacattccttaacagatctaattttatcagaaaaccaagttttgctgaacctaaatatctatactacatataagtaaaagaagckctgtaggctgggagcctcggatccctgacagttttgcagaacgctgatatctatggactctaaaatagacttcatttatagwtacccacggaccactaatggacaaaaacatgaatcaatatgtattgtggcattcaaatcctagcgctttgggagaggagggaggttccaagatggccgaataggaacagctccagtctacagctcccagcgtgagcaacatagaagacgggtgatttctgcatttccaactgagctttgaagagagtagtggatctcccagcacagagtttgagatctgagaatggacagactacctcaagtgggtccctgacccccgagtagcctaactgggagacacctcccagtaggggccgactgacaccggatacggccaggtgcccctctgagacgaagcttccagaggaacgatcaggaagtaacatttgctgttctgcaatatttgcagttctgcagactccactgatgatacccaggcaaacagggtctggagtggacctccagcaaactccaacagacctgcagctgagggtcctgatggttagaaggaaaactaacaaacagaaagggcatctacaccaagaccccatctgtacatcaccatcatcaaagaccaaaggtagataaaatcacaaagatggggagaaaccagagcagaaaagctgaaaattctaaaaatcagagcacctcttctccttcaaaggaacgcagctcctcaccagcaacagaacaaagctggatggagagtgactttgagagttgagagaagaaggcttcagacgatcggtaataacaaacttccccaagctaaagggggatgttcaaacccatcgcaaagaagctaaaaatcttgaaaaaagattagatgaatggctaactagaataaccagcatagagaagaccttaaatgacctgatggagctgaaaaccatggcaygagaactacgtgatgcatgcacaagcgtcaatagccgtttcgatcaactggaataaagggtatcagtgattgaagatcaaatgaatgaaatgaagtgagaagagcagtttagagaaaaaagagtaaaaagaaatgaacaaagcctccaagaaatatgggactaygtgaaacgaccaaatctacgtctgattgttgtacctgaaagtgacggggagaatggaaccaagttggaaaacactctgcaggatattatccgggagaacttccccaayctagcaaggcaggccaacactcaaattcaggaaatacagagaatgccacaaagacatacctcgagaagagcaactccaagacacgtaattgtcagattcaccaaagtttaaatgaaggaaaaaatgttaagggcagccagagagaaaggtcgggttacccacaaagggaagcccatcagactaacagctgatctctcggcagaaactccacaagccagaagagagkgggggccaatattcaacattcttaaagaaaagaattttcaacccagaatttcatatccagccaaactaagcttcataagtgaaggacaaataaaatcctttacagacaagcaaatgctgagagattttgtcaccaccaggcctaccttacaagaaatcctgaaggaagcactaaacatggaaaggaacaactggtaccagccactgcaaaaacatgccaaattstaaagaccatcaaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacacaaaaaaaggcaggggttgcaatcctagtctctgataaaacagactttaaaccaacaaagatcagaagagacaaagaaggccattacgtaatggtaaagggatccaktcaacaagaagagctaactatcctaaatatatatgcacccaatacaggagcacccagattcataaagcaagtccttagagacctacaaagacacttagactcccacacaataataatgggagactttaacaccccactgtcaacattagacagatccacgagacagaaagttaacaaagatttccaggaattgaactsagctctgcaccaagcagacctaatagacatctacagaactctccaccccaaatcaacagaatatacattcctctcagcaccacattgcacttatttcaatattgaccacatagttggaagtaaagcactccccatcaaatgtaaaaggacagaaattataacaaactgtctctcagaccacagtgcaatcaaactaraactcaggattaagaaactcactcaaaaccgctcaactacatggaaactgaacaacctgctcctgaatgactactgggtacataaagaaatgaaggcagaaataaagatgttctttgaaaccaatgagaacaaagacacaacataccagaatctctgggacacacttaaagcgtgtgtagagggaaatttatagcactaaatgcccacaagagaaagcaggaaagatctaaaattgacaccctaacatcacaattaaaagaactagagaagcmagagcaaacacattcaaaagctagcagaaggcaagaaataactaagatcagagcagaactgaaggagatrgagacacaaaaaacccttcaaaaaatcaatgaatccaggagctggttttttgaaaagatcaacaaaattgatagacyactagsaagactaataacgaaaaaagagagaagaatcawatagayrcaataaaaaatgataaaggggatatcaccaccaatccctcagaaatacaaactaccatcagagaatactataaaaacctctatgcaaatcaactagaaaatctagaagaaatggataaattccttgacacatacgccctcccaagactaaaccaggaagaagttgaatccctgaatagtccaataacaggctctgaaattgaggcaataattaagaggctaccaaccaaaagaagtccaggaccagactgattcacagccgaattctaccagaggtacaaggaggagctggtaccattccttctgaaacttttccaatcaaaagaaaaagagggaatcctccctaattcattttatgaggccagcatcatcctgataccaaagcctggcagagacacaacaaaaaaagagaattttagaccaatagccctgatgaacatcgatgcaaaaatcttcagtgaaatactggcaaacccaatccagcagcacatcaaaaagtttatccaccatgatcaagttggtttcatccctgggatgcaaggctggttcaacatacgcaaatcaataagcgtaatccatcatataaacagaaccaaagacaaaaaccacatgattatctcaatagacgcagaaaaggcctttgacaaaattcaacagcccttcatgctaaaaactctcaataaattaggtatcaatgggacgtatctcaaaataataagagctatttatgacaaacccacagccaatatcatcctgaatgggcaaaaactgggagcattccctttgaaaactgtcaccactcttattcaacatagtgttggaagttctggccagggcaatcaggcaggagaaagaaataaagggtatccaattaggaaaagaggaagtcaaattgtccccgtttgcagatgacatgattgtatatttagaaaaccccatcgtctcagcccaaaatctccttaagctgataagcaacttcagcaaagtctcaggatacaaaatcaatgtgcaaaaatcacaagcattcctatataccaataacagacaaacagagagccaaatcatgagtgaaytcccattcacaattgcttcaaagagaataaaatacctaggaatccaacttacaagggatgtgaaggacctcttcaaggagarctacaaaccattctcagtgaaataaaagaggacacaaacaaatgaaggaacattctatgcttatggataggaagaatcaatatcatggaaatggccatactgcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcatgctacctgacttcaaactatactacaaggctacagtaaccaaaacagcatggtactggtaccaaaacacagatatagaccaatggaacagaatagagccctcagaaataataccacacatctacaaccatctgatctttgacaaacctgacaaaaacaagaaacgggaaaaggattccctatttaatacatggtgttgggaaaactggctagccatatgtagaaagctgaaactggatcccttccttacaccttatacaaaaattaattcaagatggattaaagacttaaatgtcagacctaaaaccataaaaaccctagaagaaaacctaggcaataccattcaggacatagacatgggcaaggacttcatgtctaaaacaccaaaagcaatggtaacaaaagccaaaattgataaatgggatctcattaaactaaagagtttctgcacagcaatagaaactaccatcagagtgaacaggcaacctatagaatgggagaaaatttttgcaatctacccatctgacaaagggctgatatccagaatctacaaagaacttaaacaaatgtacaagaaaaaaacaaacaaccccatcaaaaagtgggcaaaggacatgaacagacacttctcaaaagaagacatttatgcagccaacagacacatgaaaaaatgctgatcatcactgagcatcagagaaatgcaaatcaaaaccacaatgagatatcatctcayaccagttagaatggtgatcattaaaaagtcaagaaacaacaggtgctggagaggatgtggagaaataggaacacttttacactgttggtgggactgtaaactagttcaaccattgtggaagacagtgtggcrattcctcaaggatctagaactagaaataccatttgacccagccatcccattactgagtatatacccaaaggattataaatcatgctgctataaagacacatgcacacatatgttttttgtggcactattcacaatagcaaagacttgggaccaacccaaaagtccatcaatgatacactggattaagaaaatgtggcacatatacaccatggaatactatgcagccgtaaaaaaggatgagttcctgtcctttgtagggacatggatgaagctggaaacgatcattctgagcaaactatcgcaaggacagaaaaccaaacaccgcatgttctcactcataggtgggaattgaacaatgagagcacctggacacaggatggggaacatcacaaactgggtcctgtcgtggggtaggggagaggggaaggataacattaggagatacacctaacgtaaatgactagttaatgggggcagcacaccaacatggcagatgtatacatatgtaacaaacctgcacgctgtgcacatgtaccccagaacttaaagtaaaataataataataaaaaaggaattataaaaaaaagaagttttgtaaaaattgagagsaaatcttttttcttccattaggggattatattatattttttagatgatcacgttttcccccaaagctctttgtatgtagacaatttaaaatcccaggataagataatgttaccatgttatggtaattcctgcctcagatttacaggatagctttcacatcatgcttgcgggcatcagttcactggattttatctgttttatccggaggcaaatttcatgaactgctgatgccctgctttcacctatactaatcaacatgggatgaaatcaagstagcttaaatttttttctctttataaaattgatacatggtcaatgtaggcagtttatagaatagaggaaactatatagaaaaaaataaaatcactcatattcatattcacaccactctggaataactgctattaaagctttggtatatttccttcttgtttatacaaggatttcaatgggtgggttggkggtccttggttaatacctatacttgcaaaatttttatttcattaaactttttaccatatagttttaaaatctatattgtattctttacacatgttgataacgtaattgtgtacatagcatgcttgagtgtggacactattctctgggcattttgataayattatacttctgtttttgctttgtaagctcagcttggtggtagccaggtactttaccttgtgtccctatgaactttwtgctttccaatatccttgttaatgmcaatagattagtctgtgtctagcaataattataaattaagtaataattttttctcttcgcagcacaaagtacatgctcaagtcatcagataacatgctccaatggtcagtgtatcccaagtgaatacaggtgcgaccacgtcrgagactgcccmgatggagctgatgagaatgactgccgtgagtctgttttagtccttgcrctgtatttggtttcacccttgtccctttggcattttaatcaatttgttagatttgttgatggacrtaaatgcctacaatatgcctcttgttattgcaatctcttggcagattcttttgtggattaggggtgatgttctgataagagtctatttttaacaagacattctaagagtgtcctgccttagtgcatcaagtttctgtattttttatagtaagaaacttttaacatgaacatagattctgaaaggaaggataattaaatacattgagtacagaatcaagtttggtaaattttaactgttattacacagctatagtaagtttctaggtcaaatttctcactagttttcctgcttttatgaactcaacatttttcagattacctttggaaaagtgttacattttgaaaatgtcttttcctataacagcagcatactatatctctttgtaactgatcaccmcaaaataagacatataaatcatagtattctatgtataatgtataaatattaccacaccaaaataagaaagtgcaatcatggttcattatctagtaacaggtaagtaaagaacaatcttcctctttcgaggcttatatagaagtgttaggatatgagaagataggaattagtctgctgtgtcagtcctatagtccatataattgtctttaatctcaggcataccacagtttctctctctttctgttttttattttttatttttgagaaggagtttcactcttgttgcccaggctgagtgtgatggcatgctctcggctcaccgcaacctccacctcccaggttcaagcgattctcctgcctcagcctcccgagtagctgggattacaggcatgcgccaccacgcccgactaatttttgtatttttagtagagatggcatttcaccatgttggtcaggctggtgttgaacttctgacctcaggtgatccacccgcctcggcctcccaaagtgctgggattacaggcatgagccactgtgtctggcccctagtttctctgaaaagttcttacaagtctagcgtttatgaatttttccagaagttccttgagtttttaatatatatayattttaatatatacatataacatatatttctgacaggccttttcgtgcagtcctgcatttcataaatttactatgtgctgtataaagatatagtcatgtgtcatttaatgagggggacacattctgagaaatgtattattaggcaattttgttgttgtgtgaacgtgatagagtgttgttaaacaaacctggatggtatagcytactgcacacctagggtaaacagtatataccctaggcatatactgttgctcctaggctacaaacctgaacaccatgttyccgtgctaaatactacaggcaattggaacacaatgttaagtatttatgtagctaaacatatgtaaacatagaaaaggtacagcaaaaatatggtattataatcttaggggaccactgtagtacatgtagtccatgcggtctgtcgttgaccgaaagagccatatgcggttcctgactgtasttccttttgtttgctcttaaatttatatttcaaacttcaagaaattatcccagtattccattaattggtgagcagatttttgtgtaccttagaaatcttgatcataaacttttcagttattatgtctccaacggaagattcaagttttagcctattctcacgggatatctcctctattgttttataattttgatttaattttagttctctggattgtctctaaattccttcctttgatacaaatggtttattttatgctttctgataaaagaactatcttgtgtaaattttgctaaacttcccaatatggtgctgtgactagggtaggagctaacatacattgattatggcaagcaaattgtttctagtcactgtacatttcaaactatactgttcatggaagatatacttgtatatgtgcaaaagcaagacctatgcttccatccataccatgaccacatggtgcatttttaaaaacgacccttctccagtgctttctcccttgcatgttatttttctttgggagaaatgtctgtgctatttgccattgtctctccatttcctagcagagttcctagtacagttctgttctaattttcatctgaaatattcttatttatctayttatttttaattttactttaagttctgggatacatgtgtgacgttcccctctctgtatccatgtgttctcatcgttcaactcccacttatgagtragaacatgtggcgtttggttttctattcctgtgttagtttgctgagaatgatggcttccagcttcatccatgtccttgtaaaagacatgaacttgttcctttttagggctgcgtagtattccatggtgcatatatgctacattttctttatccagtctatcattgataggcatttgggttggttccaagtctttgctattataaatagtgctacaataaacatacatgtgcatatgtctttattttttgaaagacattacagtgtttccactttggatttaccttcactctggaaattatgcaaagaatttagactaaactctggcaagtttagagatggtagcgtgtgtctggatgccacagaatagcaagtttaggggtcaaagattctcctttcagtgctttgtaaagcacayagtaggttcttcatttaggcaaatgaagaagatatttttgattaataataatgataaaccatatgttatattttgtagcattttataaatttcagagcattatataaattctagttgttactattaggttcctttatgaggacaatagggcaggcactattataatctcttatgaataaacaaaaacttcaaagagaagcgtgacttgtttgaggttgtatagtagagatagggcttaatttgtcttctagttccaagtctggtgattgctcttcatggagggctttatttacagaaggagaaagtcctatcttgtacaagttaagagaccaccagaggcctgtaccaccagccaaaagtctgtgtctttatcccttatttacaagtagatgaaaatgagtgctttattgcaaatgcagtgggactaaaggaactgctactttggggaaaataaaagtcagctgaaacagaatgtttgcagccaagactaaagtcactaatacaaccggctcacaactttgccaatgaaccttctggcaaaaacctggcaggatacgaatatgtaagtagctgctgtaaaagggaacgaagcagaggaaatgagctttgtaagttattatatctgggcaggaatttttaatcaagtttttttttatttaaaaaaatttaagtacaaatagttggtgaaataatgattcactaaggaaagaaaaccaaatttgkcttactgtttctggaatcatacaagtcatgaacccttcagggcacactgtgacctaaaatgaatcacatgcatgtaagggattttgcagtgaggcattctttcctatttccctctaccttgtttatttatagctaagtttcatttatggagcagtgtaaaaaaaaaaacctcagaaatcagaggaaatgtagaaaagaaacttcttattcttttgttagtgctttgatctggtcacagtcagatatatacaagaaggaaatgaatggcctcgatcaaagtccttagaaaatgctagtataggggatgggttgcaggagtgatcccattttgttttccttctttgtttaaagctcttgtggaaagtgggaaagggaactgccagtcaccgagcaccagccaccacyttacccacttttcacgtcaatgctgcaaggtgggtatgaggaccagctctgttttacagagattgtaaagattatcaagatgtaagagtaggggagccaggattttaacctaggtctaaaccatatgcctgtgctcttaaaagattttgctttaggaatagaaacgtataacttatttttgtttaaaggttacttagctattttattatttttacatattatygtctaaaccttttttagtatggaaggttttttttaacatatacaaaagaagcatgaagtgtatagtgaacccctttgtatgcatcactcaattacatcaatgatgaactcataactaatattgttttatttattctctttattctccccattattttgaagtatttcttagacattgtataattccacctgtaaatatttcagtatttatctctaaaatataaggactgaaacataatcataatatcattatcacacctaaaaattaaacaactcttctttaaaataatcagatattgagtcagtttttaaaattccccaatcatcttgttattttttatagtttgattatttaaatcaaagtccaaataaaatctttatgttcaagttagttgatatgtctcataagcctttcaatttrtggggtttccttctatttctgttctttacccctwgcaatttacttgttaaaaaaaaaaaacccaggtcacttgtcctggagtttcccacagtctggcttgtgttcattgtgtcccctgatgtcctttaacacattctctgtcctctgtatttcttggcaattagtagctagacctggagcagggtttctcgaccttcacactaatgacatttgggaccggacagttctttcttgtgcattgtagaatgtctaacagtatccctggcctctatccactagatgtctgtagcattgcccagtcgtgacaatccaaaatgtctctggasgttgtcaaatgtcctccaggagccaaatcatccagttgagaaccactgatttaggggactgaacaggtgcaaggattttcttggtggggaaacaagggaaggcaagagtactttttatataaatctgtgtattttcattaggagacacaggatagctagctgtctgtgatgtgagtagccattgatgatcattgctgaaatccatttagtcatagcagtacttagttattttaaatgttgcattagatatataacagctgttattagttgctttaaattagaatgttttcatgtgatcaaagattaaatgaggcttagccagaaatcatcttcatgagacatgacactttattatttctgcagtgacgatgcatggaaatcattacttgtggacaaacttagaattagcctgtgaatggggcttttgtttttctatttctcagaaatagaatggcctataggaatgaatatattaggtacctggaaaccacctaaaaatagtaatggatgttggaaaagctccaaagaaggrctcaattcttccctctaatattcaaaaggattagggagcttgatgttgtagtttgtagccctgcctgtcattccagacccctaggttgtagttcataccctttcaagcttctaaaatcaagacactgagctccaagacagagtaccttgtgtccattccgggcattcctttacagaacaaagagtggtgtgtaagagtcctctcagggaggcaggcagggagagaggaggtgagagaatgttcgagatggtgaggaaggggaggatattagggtctcaacaaaaagattatttttgagataaatgtggtatagtatgagagattcttattgcgtttggtctttttatctgcttcatctttatatgcataaggtattggtggttattttacccttttagaaaaatttttgaatatatatatattaaaacctgtgaaacaggtaaaagctcattttcccccttagttcttttattattcaatctggtcatctgtaaaatggmatctcatattaaacagcttgtcaattaacttttttttttttttaaggaacagagagattcaaaactgcggtccattttacttctaatgggattagcatcaaggaaaaaccactcatgcagggtctaagataaacatcagaacaatgcagcaattataggtcattcaattaatatattgaygtgactttcagttgctcaaaaatagtacagtttttttctgttaagtgaaaagattattttgctttttcaagcaccatattagaatgattttggtgtgaataaaactattgctaattatcgttggtttgcagcacttctcttttgttacttaggaatgccaaagaaagggtaaaatccctgttacaatgaaggctttcttgctggtaatcagcagtayttggtctgcctgcaactggggctgctttgtcccagaagttttatttctattgactttctgctctttagaatttaaacatttttctttatatctttaactgctgaaactccagctgagggaacagtgggaggggaataaaaagatggttaaagtcatttygtggactgtgagggtgcatgaagaacatgttcttcaaactcagttccacatttaagctgcccagcgagccttgcccttgctattctctctctccctgaagccagaaagaagaagcaggcgactctccaaaggaccccatcttacctgtcacatcacagatgtacctttttagcattctcacaattgagataggattcagagccctgaaacctggaggaaggaaagaaaactctcttttatttagtttccatcatacaaggatgttataaatatcccccatctttaaaaagatcctaagatccctcttagctgttgccaattactctgctcccttttacaacagagtttcctagcattaacgttaatggctgtttccgtttaccctcgtcctgtttctttctttaaaaaawttttttttacatatgtgatatatccaactgattgtcctttttttagaacccactgaaaatagtccttcatcttcaccaatctcctgaaaatattctttcaatgctaccartgactgccattatgctaagcctaatggttcttgttcaaatatcacttctcagagagctactccccacagttactctttaccttttacccagctctatttttgcaagttttttttcccattgtgacatttactttaatagctgtaatttcactctcccaaatagaatgtctgttccatgagaaatgggattttatttcattctttagtaccttgcacactataggtgtgcaataattatttttgtatggattgattaataaaatgctgtgggaattgctacttcacttgtaattttgtttaccttttaatttaattcttagcacagtatctatgaagtcagatttcaataaatacatgttgagcacaagagaattctaattaagaagaaggcagcactctgtagaataactggtttctaggatattgacattcatccagcaatgatttgctgatgagtattcaaattatttggggctacatttccagcagggaggctgagccacaccatttctagtgattggaaagtggctactcttataatgctggggtgcagctagttttcctgtctctttgattagattttgtcttttgttctgcccaggtgggtccctgggaataactactaaagtatgaaaccatggtgttgtctggctttcaatgaaaacatgtagccycgtgccactaaacatgatgtacattataaacatttgtttaccccttagaaggcatcttacttctttgtactattccttggagcatttgatgcacatttttccatcttgttgctcggtcacttttgtaatagagcttgtgtgagttttttttttttttaaggaatttagaactatrtcagtttttatctcctttgcagtttttggtgatagctctgttatgggaagaaggcagtgctgtggatctggactccttggagcaaccctctcaggcacatttctagttgaggtctaagattaggtcactgtggatagagaccagcaaggaatctcaggcttaagacccagttagtacaaagggagtgagctaaggaaaactagataacttagtttatttctctttttcctttggcttcctgaaagccacccagactaaacttgatgttagttcaattctacaagtcctcgggatgaccatattttctttctctttccaaggtgctgaatttctttctttctttctttctctttctttctttctttctttctttctttctttctttctttctttctttctttctttcyttctttctttctttccttctttctttcttctttctgaatttcttttttaataaatctggttttatataactttttattgaaagcttcttcaaattacttttggactggggaaggatatgcttctctgtttttttccttgtatattactgcattccctargagctagtccatgatggcagtcactttagggacttgaaattcaccaggaatgggggtttggggagtcgtggtggtaccttcatgagactaactttatggcctgttttttggtatygactctcctgtttgtcctggtactccttctggaaagttatttttcctgtgtaggtttcctagaattcctagawtwtatcatattgaagtactttgttaactatgccataagttgtgggaaactagagttggcctcacttttcccttcttcctaatgtggatgggaaactgactggcagaaagaaaatcttccccccttcctcttgggtttcttctttttcttttcataatctcttttaagaattttctattaccatttcattcaatttctttcttctttaatttttcgcttcttcctgttacttactctgcagcctataagtggtagatgtatctgtggtagtggttagtaacctgggttatggagccaggttgattggatttgaattctggctctccaactttaccagttatgtgacctttttcaaattccttaacctcttaatgctcaggttcttactctataaaatgggagtcatcatagtatttacttcatgaagttgttatgaagatgaaatgagtttatacatattgagtactttgacacatgtctggcacatagtttttaatacatgttattgatgatgatgatgatgatgatgatgatgattgcttgtttaactttgtgggtagcgcttgaagtaagtgctkktggccaaactggtagattctttctggcaaatcattacattgactggattaatctgtcttggagccagaggaaataacataaagtaacttataaaggatgactctaggaccttgaaaagtcccaggtgtctgggctggacttgtatcggtaatttcttgtgtgtgtgtgtgtgtgtgtgtttcccaatcttggcttaagtttcctaacctacttttaagattccttcttcataataatggttttttctatgttgtcctcagccatgttgtcaaattgtgagaataaaacatgtctgcagtcttcctgtcaagataataatgaacagtgccttatatttgtatcttactctgcttaaaatgatttccattctaagaggtctacaagrtcttcaaactacatttctacaccctcctccctgattatgtaaacagaactatagcatagaaatttcttgcttcaaaccaaatcattaacagtgaaaaaatataaaaactcttgtctgcataattttggggcagctcccaattatgggggaacaaatctgaacatgtatcatttgggattgggagaaagtaaagaaaggggaagcaaggagtggtatgaggaaggatattctcacctttttgtgttagaaaaaaccttaaaggtctgaggcttaatttatagctacttgttgatctttccatyaaaaccaaattcagaaggaagagtttccttggtgttcttatatatggtctcctctcatattgcactttaccctatacttaaattcttgcaggacattatagccacatgatggatttgctctgtgggaagaaggttagacttaggcttgccaagcaaatgaaccaaaaaataagactttagatatctcccagttggaagctcaaaggattgtgaattattgttttctggagtagattgaaactcattaacatctttagcaatggtagtagaatccattcatttctttctttgctcagtgttracagtttggacctgttgtctctgtgtgggtctccaaagagggaaaaccattcagaaacagattttcaggtattttcagtatttggtggagttagggagctctgtgcaatctttcctatgagtatacatcccaggttaactatgcaccraagagatcaaggtgtgcaggggttgagaggggtcctctgctgattgagagtgattctttatcagtgtggatggagacaagaaagctgtgtgttcctcattccaaaagtcaaactgctgacctctggccatcacaataccctccctgatgatatcaagctgggcttcttgtttgttgggtggggaatgggccttgtcagtwaacttgtagtcatgtcagtggttacagttttaatctttcccctttcaattttctggcactggctctcaaaaagcaggatgaagaaaacgagagatccatccagcacacttattccagattctttatatttataattatcaccttaaatgaagtagccaccgttcaagcccagattaattttcctccagacagatagcttatctattgcaaagagctgggttttctacgagtttttcttctgcttgctgctgctcttaaaaggctagataacacattgactctaggagctatctggctcacaggggcaaaggaattgcttgctgacctcacctggtcttttgcatctcttgaagggagaattaataaacatcacttgaagggagagttgtgtgactcatttgaaggcacatttgtaaggcatatcatctcagcgaggaaagacgcaataactctaggcactggctcacttttggactattaaaaaacaaaataaaattcagaaaaaattttaaattttaaccagctatttaaaaatgccttccattttaacatatgattgactatatgtaactctggcaattgagatatttaaggacacttaataaactagctttgaacctctggagatgagaagagttaggcttattcctttactataccaaaaaaaagatcattggagagtccatttttttaaaaagtgcaagttgttaacatggcacaagtttagtacagtttcagcacagaattttgtgcatggcttctgcttgaaaagacttgggactatccaaagaattatcttcaatatatttatatctctataaaatctcaaattgggttcttaagtgcaaaattgagactcaaagtcaattaagacataccttttccttggttaaaaagaaatcagaagatgacctgataatcactacaaaaataatctttcatgaagaagatggtcagaccaaggaagatatcacatttgtgaaaaggagggtattcaaaggccataaaaggcagaacttcaaaatattttaaaaagccraatgaactaaaatgttcacctgtgataaataatagcaacattgaacatttctcaagcacagagagtaatgtcccacccctgtactaagtgtgcacagtgagaaatgtcccacccctgtactaattgttggggattctaaaatgagtaagacaggatccttgatctcagggagtttcattatgtcatggcggaaagagatcaaccatccacagaataaagcctccagtaagaagtcatgagagacaggtggtccaagtctggcaagtagagaggagggacagatagcacgttattcctgtaagggacttcctgattttcaactgtgacctagaaaaccaggtccagtgagtagcagtgaggtggtcatatgtacataacgtggcaacaacaatttgtgctttgaaagcacattatgcttttcaacatgctttaccagacatggtcttttcaggccgctctaccctgtgcagtaggttatccaaatgtgcagatagggaagtagcaacatggagaggacatgaagcttgagtcmcagtaaatagctgcttagtggtacctctgggccgccagggctcctgaactctaggcctgctttctttytgcaacccgccagtggaagaaatggcctttcttttttccaagcttgtgcagtggtactttagtttcctgggatgttatctgtatcatgtaaaagaatgtttgattttgaactaaagttaaattctttctcattcttcatcttttggctcaaaagtyacttcttcaggggatacttttytgggcccccaaatctctctgctatgcagtctcacagtcctctgtactttccacattagcacttatcccagtttgtaatttaccatttgtgtcttatttgattaatgtctgtctcccatgtccagccttactctccatgaagccagggagcatayttcttttgtgtatcaatatatgcatttagtgacttgcatatagtaatcactcaataaatgtttgctgaaggaaatttaaggtttgtttactgtttccttytcctttttttttttttttttttttacaatagagtacccaacatgtgagcagcttacttgtgacaatggggcctgctataacaccagtcagaagtgtgattggaaagttgattgcagggactcctcagatgaaatcaactgcagtaagtattgtgcacaagatgtgcagttgtgtgctgaagctggtttatactggtttgagagagccaatatgtacatctcttcccaagttcaggttcagtgaattcatgttggtagtttgaagtcagccgttggtaggagtatttacacactggaaatcggcaaacactacaaaccagggcctttttgttcctggataactggttcttaaacagttaccagcacaccactgcttaataagaatccctttttaaactggagatgctcttcctttgagattaaatggctacaatggagttaacttctctcttttctttcccttcttaactttctgttgcagctgagatatgcttgcacaatgagttttcatgtggcaatggagagtgtatccctcgtgcttatgtctgtgaccatgacaatgattgccaagacggcagtgaygaacatgcttgcagtacggtgatttctttatgctgggtcatgttgttgggagtgttttgttttgtttcggttttgttttgttttatccccccgctccsccaccaatgtacctcttttttcaaggagaagagtcactacgtttgatggcagatggaatcagacggtcactagggggtcttggcacaagcctttgtggtgttgctcgacctgggctcctttattttccaaggatctgtgtagatgtaaagggctggtgatggacagtttgccttctttccttaggctccaggggtacaggatatattgtatcactggattctcaaatgacccatacctctgacaaccttgatagtagaatgagagaagtgtttttaagggaaaggaagttcctaggagtggctctaactctcctctttactttgaaatttctgctgcattaaagttggagggtcaggaaagtttctttttcttcgttttcttttttttggagatggagttttgctttgttgcctgggctggagtacagtggcgcgatctcggcttactgccacttccgcctcctgggttcaagcagttctcctgcttcagcctcccgaatagctgggatcacaggcatgcaccaccatgtctggctaattttgtgtttttagtagagatggggtttcaccgtgttggccaggctggtctcgaactcctgatctcaagtgatccgcccgcctcggcctcccaaagtgctggtattatgggtatgagccaccacgcccagcctgaaagtttcagtgtggtataggtggctttcttgcctccacttcttcackctgaccttgcttttatgtccatgctgttgcctgcaatgcaaatgacctctcttattgttgccacctctccacttatgttttttggaaagagtaaagttagaagactctgtgaaagagttttactatgttcagtaagttggcagctttgcgtggtgatttatttactagaatgtatgatttccctccacacctcttttgattggttggtacccatgccttagggtgttgttaaatattttcratatcaccctaattttcaatgagccatgcctgacttcctttctggaacctgggcttatttcagtgacagagaattaaagagaatgtgacatcatggaatggtcgactcagaatcatttggtcatagattagcaattacggagcttgtagtaaagtatgagaacgttggatgttgtcatgtctgcagcatctttgtctgcattttctgttctgtgccaacgcattgcaaaccatcttgtttttaatttttttttttttttttttttgaracagggtctcactctgtcacccaggctggagtgcagtggtgcgatcttggctcactgcaactccacacacccccaccaggctcatgccatcctcccacctcagcctcctgagtagctgagactacagacatgtaccaccatgcttggctatttatttttatttttcgtatttttggtagagatgaggtctcaccatgttgcccaggctgatctaatttttaatcttgaaaaacagaaaccggcacctgagttcatttcctggacccaaagctgctgktatcttcttctttctctctcttttttwtcctcctttttaaaaatttttgtcaagatgtctaagggattaaattgatatagaaatttcawtttctaggagtactgcttaggcagtgaggtgagagcactttcagtttttcccggtgatttgtgtctttggagtgcagctgttgctttattccagactatccgacctgcggtggttaccagttcacttgccccagtggccgatgcatttatcaaaactgggtttgtgatggagaagatgactgtaaagataatggagatgaagatggatgtggtaaggaggggaagagaytcctactgaaaagcattttcttcaagtgttttccagcgcttgttttttctcctttcctttttagaaattttgtgtgacaagcaagcctcaggattggctggagttgaaggggttgtttaggaacttagtgggtggggaagacggaggtgactgcgctaacttctcctaagaagattcagaacacaaatacagattaaattataatcctctcccttctatctttaaggcaaaataggtaggacagtctctgtctcttctataccccagtctgactttctccctgtaagactgcctgttttaaatagatttaaaactatataaaactaataggctggggaaggaaagaaaatagggaaaatgtcatttgtcttagaccttacaatctttaaaaatgactttgaaccttggtaacagttcagcttatttttttgttttggttttgtaaattctgattcccaaatgagtcactgacactcagtggtgaaagagaggccaccttgggaacacgtgggttggagctggggattggtaagtgtaggagaagctactatccagggaagtgcttaaagattccgtgagaaggaaattgccagtgatattcacccttttatgttgctgatattgacccttttatgttgctgatatcatcagcagtacctccaacaatttagcagttactaatacccataccctacagcaagttacctgcaccattccaatcccaggtatgataagggaaatgcttgttaaaactatgttttatgtttttatgttccagaaagtggtttttctacatttgggttatggtttttcttatactgttgacatttcactaaataaacaaagcaaatcaaaaagcccaaccacaaattcaagtaattctggacctaacttgatggccctaattctataattcatgatttaaataactacatcttttcttaggggatcatgaatttagtttgtcgataattgaggcccatatctgcttcttcctcttataaccctactgggggctgccthttccaggaaaagtggagtaattccattatgcctctccttagaatctcagtaaaagactagtggtagagttagaaatcactaacttattgtaaaatgtagatcatttatagatttctcttgttcaacttgctctrcatcctctgtaaaccactgattaacaaagagctggctgtacctcccctatggcctgtaactctctctttttccccccacagaaagcsgtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtgagtatagacatttacctgggtagctttcagataaagatatttctgttttctagaacagacgttcaaatacagtgtatctgttggcrtttgcataacaaagcaccccaagacttagtggcataaactgagaaacgtgtcttatttctcacagttctgtgggttggctaggtagttcctctggcctgtatcagctcactcacacgtcaggatgttgcagtaaaagcttgggctagcctagccttgttgacccagaggctgaaagagcaaatcctagggctcaagtactttcaaggttctacttatgccaagtttgctcaagtcttattgtccaaagcaagacacttggccaaacccagagtggatggaagaaatagactccatctattgatgggaagagcctaacaattttttagcaactccccgttcctaatccctaacrcacacacagggaggattgtttcaatggcaattttgatgaccttaaagatgttctggagattttattacctggcttatacttatggaaaaaggccttgtctggctgtactaaaaaaaaaaaaaaaaaaaaaaaaaaaaaagcttctggttcctgggttatgtaccttgagttactctccaatggcaaaactgagttggccatgcacagtgttgttcgattatgtcttgtgtgaccacattcatttatgaggaaactgactggaactagggattttttttctccttttttggggctgtagaatattcaccccaccaacaacccmtcaactctgtggacagctgatggtcctgtaaggaaatgccatttaaaaccttgatttcatcaataatatactctaactaaatttgtgattgcctagaagtgcccatgtaactgcaaccccaaggttattttttgtttcctgacaaaaattgtacataatatttaaacaggcagagacctctatggcatttttttctctatttcatttgggagcccatttaaaaaagcttaaaaattaataagagatatgtagtcacagtatgaaagttggaaaataaaaattaaccaaaagaaaaaaatataatcacctgaaatcccatctcttgaagccagccacagttaatatttctagggcttattcttgctccagtcacttgggagttcttagccctttttactatgtagacacaaagatagacccatgcatgacctgatttttttttcataaataagacttttaatgacttatacttgcacatagttataactttaaaaaggagctttttyttttcttttgtttccactcaaggcagcctcttgttctgtcacccaggctagagtgcagtggtgcagtcatagctcactgcagcctccatcttttgggctcaagtgatcctcctgccttggcctcccaaagtgctgagattacagttgtgagccactgtgcctggctaatgcttttatttttaattttttgtgaatatgaggtgtagctacattacccaggctggtcttgatctcctggcttcaagcaatcttcctgtctcagttgaacttttattgcaaagttttgcagtaagctttgaagggtgacagatttttctgtacatctacttcatgcttactgagctgctactcatggaaaaagaagctattagattaatcagtcttgtccagaggtcaccattcatttaacaaagttcttttcttcgtttaggtatgactctgtgctctgccttgaactgccagtaccagtgccatgagacgccgtatggaggagcgtgtttttgtcccccaggttatatcatcaaccacaatgacagccgtacctgtgttggtaagtgatggggggcggcggctacttgtctttcattacagtacactgatgggtgccctgatctctgacatctaggaggttgcacttgtggagagtcgtcatggtctgtyataacaaagagcaacccagacctcacagaaaacctggcaaatagggaattttaactctgagaaggtttggtgtggtgtacaaggcaaaagaatggttctgtcatgagcgagttgactagctayctggaacctatccattacttgatgagggcrgtagtccttttctgttttcttttcaagtatttggcatcaggattggtgcagccatactggttattgaatactgaactacttccatgaggttggtagatagctgctgcctgagcccagcaagcaccgctaccttgctcccctggcctcttctccaggatgcacaagcatccccaggatcccacaactaaaggttgttacctgacacagcagaggatcaccaggtcattgctcaggtgactacactggtgggccagtgcctttgctgggctggctactcattccactgattgtgacatccacttggaactatcattcaagatgagcagattctttatcatggtgcttccagatggtggctggcattaaactagacaccagtacaccaactatttcctcatatctctcctctctgacttcagaaatgatttctcccaatgagatttttgattttgatgccagctttatatctcactgtgattaggayggggccttatgatgggagaattagacttgaccaactatcatcagtttttgttttctcagtgagtttttggtgctctgatcttttttccttctatctgatttttgatacatgaacaacaaacatactagcaggaagtgatcacagagggagtttaaagaaaactatttttactgctgttgggaaaaggcatctggaaggcaattgaaactattcattaaaatttggtagtcatctatggggctccaaaatgattcagaattttcccaggatatttatattcttttgatattccttagaaatgtgaggtattctttagggcttttgggatagcaacaaacatgaaatgtgtaagaaatgcttctagaaaagtatttcttctgaaattattattttaatattattaaaatattaaaattttaatattaaaatattaaaattttaatattttagaactatttggtaacatttggaaaaaattattgaatatagataaacctaatgcagttattcagtctttagtctcagctcattgcttccaacataattatactttgtcaaatacagctaatcttaacaactactcatagccagaaaagcctttctttttttctttattattattattattattattcttcagcggaagtgctagcaaacagaaaaatgtattgataccagaaataaactctggtttgcaaattaaacttgaaattcttgagaaagtctgctcctcagcgttactgaaaactacaatcgttgggctcacttacctaccatatgccaaaaaaaattagatttttatatccagtaaagcaatccatttgagcttttccttgtgttcatagtgggtaactgtaggttcttaatatcaggaccacgtcccaaagttgcccatctaattgctcctcttaagtaactatattcaacaaggtactttaagatcaagtgacttaagtgaactctggaataatttaagaaggcccccaaatttctaatcattttaaaacattttayaaataaaagttatgatctgcaactggacttaaataagattgcaggacacattttgtgttttattgttatcattaccattatattgggaatgcattcaagtaatttacagatacttttcacacgaatgcccttattggttaggtggtgacctgactctgggagccctgcctggatttcaggcagccctgcgcaaaggggcagcctcacttctgctcagagtggggctcgtctgtgggtgtgaggccactcctgtgtctttagcaaatgtcaggctcctttkcccccctcactgctacccagctgccaatcccattcccagccttttagttctttaggcattttccttttctcttagtagaaaagaagttccaatagaaataccagaagccacattctcagtattacatcagcttttctctctttttcctttatcaactcccaaagaggmgttggggctgagctgtcttacagttgaaacttgataggccatgaagkcctttcaggaaaagtgatttgttctttcagaatcgctaattcagtcttgtgatgccccacaagctgttctcagttttttgttccacsctagagcccagataacacattttccatattttccaacatataagtctgtggtgagccttgggttgtatttccaaatgtctagggttttctaaatgtcagagattcaggccacttcaattttcaatagcctctcacaaagcgaaaggctgtcataacaatgttcttgttttataaaattttgcatttaacctactagtgaatgtaaggcagaatattgcagtattatgtgtgcacaggataatttcaggatcagagaagataccacaattaataacacattggaagtagtgtgttctaataccggggcactaattttaagttccacaacagacatcttctttcattcccgccagcgcgtttctgggactttagtacagacaacctcatttggagataatctcaaaagtctacatttgagggcctttgtgaatatgaggcctcctgccacctgcagagaccttttctgtgacctttgctgtccttcaagaatgtgtcatttgcctctgagttttgaggctgggttaacatttatttcacatttgtttcaaagaagactgtatttttctctctttatagagaactctttaaatacatgacgttaggaaaccagttacacttgtttcagctgagctgaatttttaggggaattgttgctttggtttgctctctcaagcatttcatttcaacaaatactctctgtatggctataaccctctgcatggctgacgcattacacaggcttcaggtgttggaaacctatgcaacatttattatcttagacatggctccccagtgaatacctcggtggtaatcaagaataacattgaataatcctgacacgaaatcttgtgtctttctaccattcatctgcctctggtagtsttgacctggcagtggaagctctgaggcatgctgaagcagtttactgggctcattgtttctgattgacaggacatgctgtttgttgacagaatgacatcgtggtgcagagtgagggcagggaggtcattcagcatggtggggtttcacacagccagatggatcagagggtrgccaagggggkctcagttaaaaaggggtttttgagtcattttcacagcagtatttgttggtgggaggagacaaagaataaaaaggaaagaaaaatagataaaggtattggagtgagagggggattgtaaagtagtgttttagtgttttgtgtggtttccactatcttttctactctcacgaaaaccctcaattctacttttatttttcttgtcttcactctggctgctgatggatgttaattaaccttcatattcctctatagtgatccaaggatacaatcttattgtcacaaaagtgacagcaattttatacactcattcaaatcctgttttttgtgatagggtctcactgtcgcccaggctggagtgcagtggcattatcacgctcactgcagcctcccacttcagcctcccgaatagctgggactacaggcacgtgcctccatgcctggctaatttttttttttttttttttaattcttagtacacataaacccttgccatattgcccaggctagtctcaaacccttggactcaagcaatcctcccaccttaccctcccaaagtgctgggattataggcgtgagccactgtgcctggcccactcattcaaatctttaaaccacttgtagtgcaggtgataggaagggcatttgtgctagagaattcctagttatgacttctccacctttggtttccttctgtttgacatcagaacttctgcttagagtgactccagatccttagacgtggtctcatggatcttgcattcaaaatgaagttatgacattctgggggtttgagggagaatgtcctgtactttttttcctgctgaggcaaagccttaggtggagctttctcagggctgagttaaggggacagaagggattcatcagtgagggcatttcacaccctcatgtggcatttcacttggtagtgtccagatcggattgggttttttttcctctggttagtcacggtccttggaaagaaagatatgctggctcatgttgttatgtttaatctgcagggaaaatgggatcattagaagagccttcttggggctggatgcggtggcttacgcctgcagtcccatcactttgggaggccaaggcaagctgcttacttgagatcaggagtttgagaccagcctggccaacatggggaaatgccgtctctactaaaaatacaaaaatattagccaggtgtggtggcgcacacctgtagttccagctactcggtaggctgaggtggaaggatcrcttgaacccgggaggcggaggttgcagtgagccgagactgtgccactgcactccagcctgggcaacagactgtgactccatctcaaaaaaaaaaaaaaaaaaaaaaaaragaraaaaaaraaaaagaaaagaaaagagaagaaacttggccttttggtgggttatggaatggtgggccacccagcaggaatggttgaacccaattcacaactctgacagttgctgcaaatgtaatcagatcatagaaatctggagaattctagacttgggagtgcagtggtttcagaaattataatctacttgagaacttcctgaaaccagagggtgtgggaactctattgttatagtttgtataggtcatcctcccagggaagcgaggagggtgaaggatgatggagagtggacgtggacttggaaagtcagatgtaccaatttctgcacccctgaagccttatagtctttaagaaagactcttctaatattttgttgtgttctcccctccatattctattgtttatgtcaattatattggaactatttttamacagtagaactgggacttctctggtaatgaacagagctctgtcatgtaagggacttcaatgaacacttactaaatgagtgaataataagttaaccaataagtagaggagaagacatttttgatgtcttgaaaataagttcaatttaattttggttataattttttgacatcagaggaaagacagctgggtaaatagacctttccaagtactttattgcagtcatagatttgtttcttcctgaggggctgtctataggcaggtcttactttattcagaaatagtgctgtccaatagaactttctgcagtgatgtaaatgtgtatcttcactctgtcatattgtaaccactagtcatatgtggctattgagcacttgaaatgtggcaagtgactaggaaagcaaattattamttttattttattttaattaatctaaagatacatttagatagccacagggggttagtggctrccatgttggaaagcatagtattgaagggaaacatttacaccaaaatttatatatttgtagactaacattaataaatgaaatgcagtaccatagggctatgaattcaggaagtgttgtgcattttctgtaaagttatccttcatgtaggtttaaaaaatgatgtaaatgttctttttccttacatgaagatggttgttataaattctcagaacctgtgcctaaytccagagggtgtttatttagacatgggcaacaccacattcttggccatcttatctaggatttttgtcagagagtgcttaataaatgctgataaccttgactacaaatgtgtattttccatatggcagagtttgatgattgccagatatggggaatttgtgaccagaagtgtgaaagccgacctggccgtcacctgtgccactgtgaagaagggtatatcttggagcgtggacagtattgcaaagctaatgattcctgtgagtaaattatggacacctgtgtctctgaacagtraacagattctaatagcttctttccttccttctgatgacaacagaattatcagcatttttgttgttggcagggctttatcattacaaatcagggatggctcctactgcctagaaaaattggtcaacattaatttcatactttgattattaaggaccaatttgtcgaytaatggtgaccattattaatattttttaattgattgattgtttactttgcctaggctatcatgtcacccacctttaattgtggaataaatgctatgcctacatttgattggcttggacatttaacttttaattaattacctaccacaaaagtaggcgacaactatctacagaaataattttcacagtgttcttgcaaaatttagggatatttccaaatggacatgctaaatttggattaacaattttttgaatgcactaactctgggtaatttgttggaatcartgtaagagtatgaaaagtagagagtagtacagagtagtagagaaaagtcatggagaaaatctgcaaaaaatagatgagggctccaaagcattttgtcgctgttgatttctccggacgaaggtctcaatataaactcctattttccaatagttatttaacacttgattttgaagtgtctttggtgtcttctgaaacttaactgctcccatgactgaagaatggcccattttctacttgtttttgtgtagaaatacctgatttgctgtgtagtaacttttaggttcagcggatttttaacaattcaatgtgtttatttttgcataggtaacatatttatatgttcacaaattttaaattataagaagatatgtagtgaaatgccttcctccrtaactattcccctctgcatggttttcaccttctctttcctatgagtaattgccgtttctttattttagttctagagattttttaatgaataaacaagaacatacaaatatagatatttaactgtatttacatatctatatatggtagtaaactatatgcacagttctgcatcttgtgaatgtactgaagatattttccagagctttccatttcagcacatgaagttatttcttaattattttatttatttatttatttatttttatttatttatttttgagaatgagtctcgctctgttgcccaggctggagtgcagtggcgccatcttggctcactgcaacctccgcctcccgggttcaggcaattctctgcctcagcctcccgagtagctgggactacaggcttctgccaccacacccagctaatttttgtatttttagtagagacggggtttcatcatgttagccaggatggtcttgatctcctgacctcataatttacctgccttggcctcccaaagtgctgggattacaggcatgaaccaccgcatccggccttatttatttatttttgagatggagtcttgctcttgttgcccaggctggagtgcaatggcaagatcttgcctcactgcaatctccgcctctcgggttcaagcgattctcctgcctcagcctcctgagtagctgagattacaggcccccgccaccatgcccagctaatttttgtatttttggtagaaacagggtttccccatgttggccaggctgatctcgaactcctgacttcaggtgatctgcctacctcagtccctcaaagtgctgggattacaggtgtgagccactgcgcctggccttaattatttttttataatggcataatattccttcttttatgttcataatttgtttaactagtcctctactgatcaatttttatatcattccttatcttttgctattgccaataagactgcaattaataccttgttcatatatcattttgcatacctgsgagtaaacagacagaacagatttggaaccaccattaccatctttttcagagtgatttcctggtaatctttaaaatgtcttctgtgtttaacaaaatctaaagttgcacatggggctaaggtgcccataccatcaaggagtctcgaaaatatctgagaaatactctcctcagtgtcattgaaagtgcattggactagcatccagaatgcttgaattcttaccaaattcttcctaacttactgagattttggacgcttcattaagcctttttgtgcctcaatttgcccttctgtaaaatggayagaatgctagctatctgtctgcctcagaggtttatgttaaaatcaggtaagacaacctagaagatagcatttgaaaaagcagaaagcatatcatttgtaagctacttcaccatccttgctcatctgaaggagtggtgatgccttccttcttcgcatttagttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggtaaatagaaatttcagtagctgaatggaaccctgagcacaaagtgttgatagcttttcactyttagagggagtagaggggaaagttcctttgttttctaacaaaaaaggcccttgagatattttatgttaatcagcaccttttccatgctatactattacatstgacctattaaacaaagcagtctattatatggattagccttgagcaacttttaattttattcgaagtggagtccaggagcctaattaaaagaaatagtagacattctttcaaaactggatagatatttggtagtaatttttgaaatttgatcatttaaaatgtaaaaagcacactgcttttctggatgataaaaatcagatttttacctgcatcttctaaatggaactgtaattcgggatcgagtaacaaatattgacggtattttgtttaatggcccaaattttgtttcactgtcttatttggaaagtgtgatgggtttaatttcatcttggagtaatgcaatggagatttttgaaacataaatttcagaaactcttaaagagttatggaattttatttatttcttcttacattttattataccattaatacgattctcatttatttaaatgataacttgcatgaaatttctgaaaattgagaatttagatttttagcacttctgatttgattakagctaaaaaaawtcaaaacaamccacgtagttagtgatgctgaagaaatayaataattttggtttttctttcaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggtaagtgatgtgaaaacatattgattcctgtatttttagaattttctctctccctctatacackgaacatctactggattaatcaaaggctcattctgatttcttttaggctgtatactctagaagccatgtctattttrtgcccttatttatagaagctttaagagagtttattaaatataatcctatttgaggacatgttacccaaacacacctagtggtgtactaaaaatacttgttgttttggggctatgaattttattcttagtgtttgccacgttttcctagctaagagattggattttgtgttctaactcaatctaataatattattacaactaaacatcacttatgcttcattattattaagatgattactctaacatgaattagctgtaaagatttttaaagatggaggttggaactattcctttcagaactttcttgatacaggctgggattgagatatcaatgctaatatctcattacaagttgttcagtctgaatcaatccagcaacaccgataatgcttttcttcaggtttaaatttaaatttcccaatcttcacatttgagaagtgttataggagacttagctttctcctagaatttcacaattgggtcttaggacccttggataagctttaggctattttagtctttgtgartgatgattattcagttctacttcattatatcagctatccttccttgaaaatgacggaaatgttctctgtgcctcagaatggaaaactgaggagcaaaatggcttgatagcttcttttaaaaggtatttgtaagttttcctgggtgtaaaaaagagaagcaaaggacaaataaaggaaacagaggagaaagttcagaaggtgaatatgaattttttttttttgagacaggttcttgctctgttgcccaggctggagtgcagcagcacaatcacagcrtgcygcagacttgaacttctgggctcaagcaatcctcccacctcagcttcctgagtagctgagactatgggcaagtgccatcatgcccagctaatcttttaatttttgtagagatggggtcttgccatgttgcccaggctggtcttgaaacatgggcctcaagcaatccttctatgttggcctcccaaagtgctaggaccacaggcatgaaccactgtgcctggctggctgaatatgaacttttagactgccatattagtgcatcataatagttgctatttggaactgttgatgctcctgactgacccccacagtctctttaaaaaaaaamaacaacttaatttccctgttgttttatactgtggttctctaatcagctggataaaatttccattgatccaaacacactgttaaaaaaaattcccaggttaacttgtaaaataccagattctttcatcttctgtttttcttttgtagttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggtaagaagtattttttatggcttatggctttataagttgcagggaaagtgcataaaatggctgsagagaaatatcaaaggaccagaattaaaatattgctttgttggtggacatgatagctttaatgacctttgtactgacatttgcatgaagtgacctgctctattttgttaacttttcttgtgtcccataacacaagaggtaaacgctcattaaatataacctccagcatttgttctttgatttctcctctccaactcttcccctagtcccacatgatgcacattattttcattcactcctgagttcatttgtgctttgtttctcaagatcactttcccttttaattttctaaccttcccccaataaatacatgttttattaggtatttgatgttgcctactgggaattaattggattttactctgctcttatatatttcaaatttcaaggagaaattctttgtattgtatttttacctggtatacaaagatacttaaacrgcaatatttgaatgtagaatatggctttcttttttttttttttttttgagatggagtctcactctgtcacccaggctgaagtgcagtgatgcratctcggttcactgcaaactccacctcccaagttcaagtgattctcctgcttcaacctccccagtagctaggattacaagcatacaccaccatgcctggcaatttttgtatttttagtagagataaaatttcaccgtgtttcccaggctggtcccaaactcctaacctcaagttattcgcctgcctcrgcctcccaaagtattgggattacagatgtgagccactacacctggctgaatatggcatattttttttcatctttttactctgattagagctaactayaacttaatgtaaaaaaaattattttagatcctctccttttggtattttcaaaaattgggtaaaacatgttcttcaaattttgacccaaaatattattctttgtggattcagcaaataggctggttaacttaatttttcccaatgacttgattttattgttttctcaatgaaagcaatattatagttttgtttcctcttgtatttccattttgtaaggataatatcacagtttgccattggattatatatccttgggacaatctctgcttggttaaatgaagtattgkgtattaatatggtgacttcctatcactgaaactggcttccataaggagaatatgaataaattttatgaaaaaattagctaacccaataagtcacataaaataattgtgaaattgcttaaattttttctctttgggatgttttagcattatattatatagtctaacttttgctgaagtaaaaaaaagtaaagcataaaagataaaaatcaatggaatttcaaaaagatttgagtggtttgctggctgtgaagaaacatcaaagaaatattaaagctcacaagtacagctgaaatcataaagtcattgcctctcgctttgccagcaggtggcattcagggttttggaatttgctaactgagagagaaactattctctaatcttaatgtaccatgtcattatagaatgtttcaaagtgtgcactaacctgccaccttaggtttctttgtttactcccctttagtgtgtttcccagctttaatatcttcaagtcttttcttagagctctattgtcctttttagttttcaggggatgctaagatttttctttgaggtctttgtattacgccaaaataaagaaaataagagttttcccatatcaaccgtcctctgcctcactctgttcatgagtctaactgaatcattgtttatggagacatagtcacggggggcgttgttgatttcctctcttcgcttagtgcctaattttacttctgttttcttcccagttaagtggctttgggcctccattacaagtatgatcagttgatagttccatcaagcagatgcataagagtggtagtggcattgcttcttgctttccttacagtgacatcaggaacagaygtgggcgtttkctggggcttgaaccctaccactcactgtcctgctccctaattgctaggaaatgctcaatggtgmagtgggaaatagttggcaaaggcatcttttcccagacttccaaagtcttggtatactctttcacttatggtattcaaaatgctatttcacatcttagccttttagatgtggggcaacctaaaaggaatgaagaacaaaaggggaaacagtaaattccaaaaaagtctaggacaagctaaaggattgactgggactggaatgtaagtctcaagggtcttttccaagagacaacatgaaaatccttctatcatatgtagatggaaatatgtatacatctaaaatgtatcttttctatctattccgtatttgtgacaagaaattatttagcttttcaggcatttaattgaactaactacagctttaattataataaagcaaaactaacaaattgtatgatatatatgtgtcttttataacaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatggtaagcctcagagcagtggtaaccatgcttggtaccggacttggtggaaaggttttctcaaagctttgaaagttaataatgaggggtcttatgtgatttgggtggcattctcaagtatatgaagggttacccagagtgttaaactctctgaaactggttctgcaggttaggagcattctgaagaaactgatgtatttcacagttaaatgccaaatctagagggaatttagagatttatttaacagatgtttattagcacctgcaaagatgcttgggggtatagcagctcacaaaccaaaccaaaatacctatcctcattctactgggaaagacatctatttcaaacttctaatattacagttaaggaaacaggtcccatagaagaaaatgacatgtctaagtgtccattttcggtagcatcagagccatttttttcttcttctctgttgcatatgtatggcacctgttctttggttctgattaatctgtcataggccaactgggtttggtgtctctctggctggtcacttattttaaaaaaagaaatattttgattcagacactgcttagtcttctcctgttattttaccacgtgattttttctttttattttttctgagatgggatttccactatgttggccagacttttctggaactccgggcttcaagcgatcctcctgccccggcttcccaaagtgttgggattacaggtgtaagccactgcacctggcctatcataagctttgtttatgtttccaggttatagcttgagctttgataagtctatcaggactgtatatagctcttttctgtatttgcttgtggatcaaagaaaaagaaacataaactacactacgttggtagaaagcttaatattggtgagcaataatttagaggaaaacagatttgctctaaaactcatgttaagtgatggatctatttaggatgaagaaagactgcaaagtaatgaggttaacttaacaaaagcccaaccactagaamtgacacattcagatgaatctccttcaatgtcatcatcctgggaaagtataaacttgtctaaaaatagatattttatctgaaaacatttttggaaatatctgttttgaatagtttttacactcaattcacaactaaactcacacctgccctcacattagatccattagatcaatgatcaatgtgatcactcaaattactattttcattatttggctcagaatgacatctgcctattgtttccccaaatcaatccacctgagaagataaagagaatattttaaagaataagtcaaaggctaaaaagacaattttgaaagcagatataaaatttctagctgtggcagtgctcttcctaaggtcactactttgagagtggcttttggaagtataaactggtttgtgttgcagacatttaaggttttggaatcagatctggctttgaatcctagtcaagctgtttagctgctgaataatgttgggcaagttatttaactgtttagattcttggtttctcctctgtaaaattggaggactaatacttacctcttagagctattggttaagttggtttacttacaaagtaagcatccagtgagtaatatttattatatcctacaaatggcaaaaaagcagtgaagtgtgggttttcttttgacaattatttstaatcatggaggatagsagacatactctgacataattattggggagaaagttgtaggagtcctttctttttttttgccaccgtctgttggagagtggatgggagagcagcagtgaaattgggagggttagtgtagccagatgtggatgtatccagtagtaaccagtagtaatgttttcaacacgttgctaatccattactctatttcacctataggtgaaaagggctagaagtggcttcaygtcttggataattacacatttctaattgcaatttaaccctgtgcatttttccttccagctaccaatccgtgtaaagataacaatggggrctgtgagcaggtctgtgtyctcagccacagaacagataatgatggtttgggtttccgttgcaagtgcacattcggcttccaactggatacagatgagcgccactgcattggtaagaagtctgttttggacrttgttggcaggtgacacaggtgtatgtgtgtccaaacctctaactagactaactgctactcttgaactggaccagctccctgtctaacttcttgactgcaaataagctttctgtagcccacagggcatcttccttggtaggcaccacttctactatacacagaactatgtttgaaaatgtaaatttctgtcttttgggattttgctttaatcccacatctaaggttttcttgggttcccttccccctttgtttcctgaagcctttttctcctattaactatgatcttgaaattccatatggttgaactttgagctcttttctatgctatgtataccttttccactttagatgttagccttaactttgatgggaagtactgtacttctccccactttgacttctcctagaccaccacgtatgcccctttcaaccaggtaatcacatctgaatcttatctggcttattttttctctctgtattccaaagtaaactcctgagcattggggtggctcagttactcacacagtttttcacctttcagttcaaactttcttgtatctgcctccatattcctgatttcattcttaccttgaaggtttcctttcttcctctttggtttcctacacatctattcacacttaagccatcgcctgggccccagctaatgatgaaatgcactcctacaatatttgtttttcttattttcacttctacawttctcctttctgtgcctgtgacaaattcttgctctccagatgttgcggtttctagcgtcgtatataaattatcttattctaacccagacacatttgttaacttcttaggtagttttagattcagaaaaatcaccctcattaaaaacaacatgtatttctaactattatatcaatagtgcgttgtctaataattttgcttttaaattccgttactgcgatttttatctttgtcttgggcatacctccttcatcttcttgactccctggcatcctgtcacagtctcctctttgctgttaaacatcacttcttcttacctatttcctttatccctccccttccttccctgctttcactcctttayatctttatatttctgattgctgttaattatcttggtatctactgtaaggttcttggtgtagatctctatgcagaagttaaaccaacttgaggattgttacggaattactatagagttcagctctgtatgatttttaaacaaaagattgatggcacaggtgagaaaggtttctgtgtgtgtgtgtgtgtgtgtgtgtgtgtgtgcatgttttgcctgtttattgtaatgatacttataacttgataattaaaactcagtatctaatttttaagcagtcctttttattttatttatttatactattttactttaagttctagggtacatgtgcacaatgtgcaggtttgttacatatgtatacatgtgccatgttggtgtgctgcacccgttaactcgtcattacattagatgtatctcctattttataaattaagcatatggatatcatttttcatataaatacattttaaggatacatttcttaggaagaaggaagattctaatacttgtatctccctcatagttgcttatctttttttcttccctgtattatttctaactatgctttccaaaaatttatttttacatttatttcagaattatattttataatttaaagtttgctctgtggatgcatttatctggaatttgggaggagagaaaagaaccatgctgtgactgactgtgctgtgttattcttcctacagctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggtgagaaaggtttgtgtgtgtgtgtgtgtgtgtatgcgtgttttgcctgtttattgtaatgatacttacaacttgataattaaaactcagtatctaatttttaagcagtcwtatttatttatttatttatttatttatttatttatttatttatactattttactttaagttctagggtacatgtgcacaacgtgcaggtttgttacatatgtatacatgtgccatgttggtgtgctgcaccygttaactcgtcatttatgttaggtatatctcctaatgctatccctccccctccccccaccccacgacaggccctggcgtgtgatgttccccatcctgtgtccatgtgtgctcattgttcaattcccacctgtgagtgagaacatgtggtgtttggttttctgtccttgcaatagtttgctgagaatgwtgrtttccaryttcatccatgtccctgtaaagaacatgaactcatccttttttatggctgcatagtattccatggtgcatatgtaacacattttcttaatccagtctatcattgatgaacatttgggttggttccaagtttttgctrttgtgaatagtgccgcaataaacatacgtgagcatgtgtctttatagcagcatgatttataatcctttgggtatatgcccagtaatgggatggctgggtcaaatgttatttctagttctagatccctgaggaatctccacactgtcttccacaatggttgaactagtttacagtccctccaacagtgtaaaagtgttcctatatctccacatcctctccagcacctgttgtttcctgactttttaatgatcgccattctaactggtgtgagatggtatctcattgtgattttgatttgcatttctctgatggctagtgatgatgagcattttttcttgtgtctgttgcctccataaatgtcttyttttgagaagtgtctgttcatatccttcacccactttttgatggggttgtttgattttttcttgtaaatttgtttaagttctttgtagattctggatattagccctttgtaagatgggtagattgtaaaaattttctcctattctgtaggttgcctgttcactctgatggtagtttgttttgctgtgcagaagctctttagtctaattagatcccatttgtcaattttggcttttgttgccattgcttttggtgttgcagtcatgaagtccttgcccacacctatggcctgaatggtattgtctaggttttcttctaagggttcttatggctttaggtctaacatttaaatctttaatccatcttgaattgatttttgtataaggtgtaaggaagggatccagtttcagctttctamatatggctagccagttttcccagtaccatttattaaatagggaatcctttccccatttcttgtttttgtcaggtttgtcaaagatcagatggttgtagatgtgtgatatcattwctgaggactctattctgttccattggtctatatctctgttttggtaccagtaccatgctgttttggttactgtagccttgtagtatagcttgaagtcaggtagtgtgatgccttcagctttgttcttttggcttaggattgtcttggcaatgcaggctcttttttggttccatatgaactttaaagtagttttttccaattctgtgaagaaagtcattggtagcttgatggggatggcattgaatctataaatcaccttgggcagtatggccatttycacaatattgattcttcctatccatgagcatggattgttcttccatttgtttgtgtcctcttttattttgctgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagmctttgctgaagttgcttatcagcttaaggagatattgggctgagatgatggggttttctaaatatacagtcatatcatctgcaaacagggacaatttgacttcctcttttcctaattgaataccctttatttccttctcctgactaattgccctggccagaacttccaacactatgctgagtaggagtggcgagagagggcatccctgccttgtgccagttttcaaagggaatgcttccagtttttgtccattcagtatgatattggctgtgggtttgtcataaatagctsttattattttgagatacatcccatcaatacctagtttattgatttagcatgaagkgctgttgaattttgtcaaaggccttttctgcatctattgagataatcatgtggtttttgtctttggttctgtttatatgctggattacgtttattgatttgtgtatgctgaaccagcattgcatcacagggatgaagcccacttgatcatggtggataagctttttgatgtgatcctggattcggtttgccagtattttattgaggatttttgcatcaatgttcatcagggatattggtctaaaattctctttttttgttgtgtctctgccaggctttggtatcagaatgatgttggcctcataaaatgaattagggatgattccctctttttgctttgattggaatagtttcagaaggaatggaaccagctcctctttgtacctctggtagaattcggctgtgaatccgtctggtcctggacattttttgggttggtaggctattaattattgcctcaatttcagaacctgttattggactattcagggattcagcttcttcctggtttagtcttgggagggtgtatgtgtccaggaatttatctatttcttctagattttctagtttatttgcatagaggtatttacagtattctctgatggtagtttgtatttctttgggatgggtggtgatatcccctttatcattttttattgtgtctagttgattcttctctcttttcttctttattagtcttgctagcggtctatcaattttgttcattttttcaaaaaaccagctcctggattcattgattttttgaagggttttttgtgtctctatctccttcagttctgctatgatcttagttatttcttgccttccgttagcttttgaatgtgtttgctctcgcttctctagttcttttaattgtgatgttagggtgtcagttttagatctctactgctttctcctgtgggcatttagtgctataaatttccttctacaccctacttcaaatgtgtcccagagattctggtgtgttgtgtctttgstctcattggtttcacagaacgtctttatttctgccttcatttcgttgyttacccagtagtcattcaggagcacgttgttcagtttccgtgtagttgagtggttttgagtgagtttctggatcctgagttctaatttgattgccttgtggtctgagagacagtttgttataatttctgttcttttacatttgctgaggagtgctttacttccaactatgtggtcaattttggaataagtgcratgtggtgctgagaggaatgtataytctgttgatttggggtggatagttatgtaagcagagattttactaagcttcctaaatagttttagattgagaaaataaatttattgcttttttatggattaaggtaaaacaaacacctttcctttattttagaaacacgttatttttgggaaccgagacgggaggattgcttgaggccgggagtttgagaccagcctgagcaacatagtgagattccacttgtaccaaaaaaagaaaaaaattagccagatgtggtggcatgtacctgtagtccccactacttgggaggctgcaatggaaggattgtttgagcccaggagatccaggttgcagygagctatgaccataccactgcactccagcttgggcaacagagtgcaaccctatctcggaaaaaaaaaaaaaaaaaaggttacaaacgtgtgtgtattttaacaatgaccaatgttaacataaaagaaatgtcacgtgtatgagagccattaacagattaattgactagacactgtttttcatactcaagcagccagattgattaaaggggaagacatctcttcagggatgctggactatgtaaatgccaagggtttggtttgtaatagtaataaaatttgtaagcaatataacataccaactaagagagccagcttaggagctacactgcctggttccaaattccagcttcccacatttcctagctttgtaactttggggaagttactcaatttccttttgcctcaattttctagtctgaaaaatatgcggttcatatattgctcataaggttgttgagagaatttttggctaatgcatgtaaacacctagagtaatggctagaaaatagtaaatattcagtaaatgttggatatcattwtatctgttatcaatataaaaccatattgcccaccctcccctgcccctaatccagacctgctctggggagggaacagctcttttgactatttcttcttttgtttgtctccatgtttctaaatgctttgtttatacttctatttcttgatttatcatttttgatatttacttccttgttctaggtgagcgttttgctttcttacatcattcttctctcccagcttctgacttccctccccccattctccttaaaaagctagattataatttttggttaaattaatcatatgtgtttatattattaacataatataaatrtaaatattgttcactgctcagccaattagtattctaggatgacatttcttgacaatttttgacaattgccccattttcatttgcttagtttttaaatataacaatcatgtattttccccaaatgctctaatagctctatcaaatgcctgtacaaagacagaaaacaatctayaattttttttttctttctggagacccctatcctgtgttccaattgggacttgtttttctctggcctggtgcacagacttctctttgccactcccctgtgctggaacttctgtttgtggcaggccatttatttctttttctagatttatttcctcattttgmtgaaacamgttacatgatagcttcctgagaaacataagtaggtggcatatattttgagtctttgaatgtctgtgagtgttttattttgctctccatcttgactgtttggstgggtacaggttgcaagttaatttaaacctggaatttgaagacattgctctagtgacgtctaatatctagtgttgagtccagtgccattctgagtaccatttctatggatatgactttgatatggatatggatatgacattaaaaattaatcttcctctgtttccattttctctggattccttttccttttgatttcttttcaactttcttctttttgatggaagctttttccaagtgtctgagttgctagtttggtattaagggtgaggttataaaacctgacccaaaagtctgtacatgtggataggccttgtcagctggtragcttcaggcaggaaggtggcttggttgccagattgctccccaaggcaacattagtgagtcttttctggagatggtcaatttctccttcatagatgcctccattttccttcrtgaggtaaggggaagatgtggggagatggtkgtctgttctgggggtgattaatttctcctccatagatgccttcattctccttcttggagtaaggggaagatgtgggaagatggtggtctgttctgggggtgattaatttctccttcatagatgccttcattctccttcttggggtaaggggaagatgtggggagatggtggtctgttctgggagtgggcagaggaaagggagctgagggcgccctttcagtattcctataatcctcctgtactcagttccacatccatctcagttctgtgttgaggactgtgccttgaacccatagccattctgcttcagctcctccagagaaaatctgtggtcccttagaggagatagaggagtggcgtgacactcaggatctgggagggacctaggcattggattgctccttatcttgctttatctgagccccttagttcctcgcccctgcctttgttaggacctggtgcctctgagtgtgagtgcactgaggcttctgcatatgtgggtgtgtctctcttctgttgacacttagtttgtagcattttccccttcttaactgagttatcactcctccaataccttacttttcaaacatttgttggaattactcatctgctgttattttactgtcttttaagtagaatttcggaggaagaggagataaacatgtttggtttgtcaatctgctattttgaatgagaaattatcttttttgaggacttagaatcaggcccactgagcttggagcactgcagtcgagcttagttctcaggaaaaggtagtattgggtttctagctgcatgcaggccaagtctcccacaggcacctccacaggtcagcttccttctgttttgttgatctggaattctcatagtatttttggtaaacttcaagttcgtatgctgagcaacctaccttttttwaatttttttatttttatttatttatttattattatactttaarttttagggtacatgtgtacaatgtgcaggttagttacatatgtatacatgtgccatgctggtgcgctgcacccactaactcgtcatctagcattagttatatctcccaatgctatccctcctcccgcgccaccccacaacagtccccagagtgtgatgttccccttcctgtgtccatgtgttctcattgttcaattcccacctatgagtgagaatatgcagtgtttggttttttgttcttgtgatagtttgctgagaatgatgatttccaatttcatccatgtccctacaaaggacatgaactcatcattttttatggctgcatagtattccatggcatatatgtgccacattttcttaatccagtctatcattgttggacatttgggttggttccaagtctttgctattgtgaatagtgccgcaataaacatacgtgtgcatgtgtctttatagcagcatgatttatagtcctctgggtatatacccagtaatgcgatggctgggtcaaatggtatgtctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgaratggtatctcattgtggttttgatttgcatttctctgatggccagtgatggtgagcattttttcrtgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgygaatattttctcccattttgtgggttgcctgttcactgtgatggtagtttcttttgctgtgcagaagctctttagtttaattagatcccatttgtcaattttggcttttgttgccattgcttttggtgttttagacatgaagtctttgcccatgcctatgtcctgaatggtaatgcctaggttttcttctagggtttttatggttttaggtctaatatttaagtctttaarccatcttgaattgatatttgtataaggtgtaaggaagggatccagtttcagctttctacatatggctagccagttttcccagcaccatttattaaatagggaatcctttccccattgctttttttctcaggtttgtcaaagatcagatagttgtagatayacggcgttatttctgagggctctgttctgttccattggtctatatctgtgttttggtaccagtaccatgctgttttgcttactatagccttgtagkatagtttgaagtcaggtagtgtgatgcctccagctttgttcttttggcttaggattgacttggcratgcgggctcttttttggttccatatgarctttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttcttcttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggattttctagatatacaatcatgtcgtctgcaaacagggacaatttgacttcctcttttcctaattgaataccctttatttccttctcctgcctaattggcctggccagaatttccaacactatgttgaataggagcggtgagagagggcatccctgtcttgtgccagttttcaaagggaatgcttccagtttttgcccattcagtatgatattggctgtgggtttgtcatagatagctcttattattttgagatatgccccatcaatacctagtttattgagagtttttagcatgaagggttgttgacttttgtcaaaggccttttctgcatctattgagataatcatgtggtttttgtctttggytctgtttatatgctggattacatttattgatttgcgtatattgaaccagccttgcatcccagggatgaagcccacttgatcatggtggataagctttttgatgtgctgctggattcggtttgccagtattttattgaggatctttgcatcaatgttcatcaaggatattggtctaaaatgctctgttttggttgtgtctctgcctggctttggtatcaggatgatgctggcctcataaaatgagttagggaggattccctctttttctattgattggaatcatttcagaaggaatggtaccagttcctccttgtacctctggtagaattcggctgtgaatccatctggtcctggactctttttggcaacctaccttttaaaatattcctcatagtcagtggttaaactctgtatgctttgttgagggaggcattacattgttcttttttttttttttgaatgagtacacagtatatgcaggaaatgagttgtcagaaatcaaattagctaatgtggtggtgtggtgtagtgccagatacttgggaggatcacttgaggtcaggtgtttgaggctgcagtgggctatgactgtgccactgcactccagcctaggtaagacctgtctctaaagaaaaagaaaaagaaatcatattaaaagtcaggattagctgaatgaarccctcaggagaactccctccttcaatgataccttcttttttccaaattctctttttctactgacttttccctatcatcagatatgctcaagtttctcccatcctaaaaaatatgcaacttacccttcactccatgttcctctttagtgataaccccttctctgcatttcatggtcaagtttcttgaaaggttgttttgcactttcctatcccttcttccacatttctcactgattactcacctcttgcaatctgcccaccaggtggctgacacccctctcatcctggtcacctctaatccctttcttgctaaattaaataatgcctatcagtcctgtatttggtacttcagccatcttctctcaaatattctttcttccatgacagcatactcctggatttccttctatttcttgatcattttttttttttctagtgtaccctggagatcttttctttttctcctgttctataaaaaactgtaaatctgttgttcaacattggtcctcctctctctgaataatttcacacctttcctgcctttgattactatctatgtagcaactataaataattatggggagacttttataatagtgcatttactgagtgtttttcctcctaaactggggaatgagggaaagaccaagcaagcctttctgtaggtcatgataaaaatctctatgcaagttctctctctgaggttcagacccatagtgccagctgccttttggatacgtcacctggatatcctacaatcacctctaaaccaacatgtctaagtggatgcttcatccaacttctcacaggccttagaggaagggcatgaccactcaccccttccttggtgccccatccccacctggtggtcatcatgaacatctccctctcttttagcctctatcattaactcattaacctccagccacactcctagaacatgtagagttttcagtctctgtgtctgtcaaccaccccagacctctgctttgccatgtggcccattaggaatctgtgctctcagaccatcctatgcatctctccatctcagcactcattactcttttatttttgtctcttggcctagttgcctcctcctctttcaccacctcactatgaattaccttgagggtggtgtccacacttctttccagatgcttaacttctctttgacttggttcyctcatctgtagaataggaacgatactaatgcctacttgattgagtggctgtgaggatggatgaatccatgtagaatacttggtccagtttctgccacctastaagtgctcatttaatctaagctgtgattattaacactaytaacaatattgtgttttctaaatatatagttggctttctatcacatagagaactttcttttcacaatttgctgaataaatgaagagaaaaagtagtaggattttttcttcctactgcaaaagaaagaggtatggctgtttattctgattcagattttctttagtgaaaaaaagaaaaaagagggtaaaagaaagcataataactccataaagaggaaagcgtttttttttttgttgttgttktttttaatcagttctgatttcctttctggtatctctgctggtgttttcaaaacttggcaactttgtggctgtggaagactgttgatgagagggttgggcgatgatacctcagggttaccctcaggtcgtacctggtggtgtcagcttatcagagccgwctccgggtggtagtaggtgaactcaggtatctcttcttcagatattctacagtgagaaatttttttctggaaggttggacatgggagtaaatccaggccataccattcctggttctgtttgtcagtatcatatctactctttgagatccaaagtttgaggaatggatagattctaggtttgtctcatgttattgctcagcagcttacagagttttttttttttttttttaaagaattccacatgtgttcctgaaatatgctctaactctgacacaaaatttcagtgtgcattagtaggaaaattgatgccttacaaaatatacttagcttaaaatatgtccatattttaacttataggaagagaaattctcgcagctaacagggtggaaaatgttgaaagtttggcttttgaytggatttcaaagaatctctattggacagactctcattacaagagtatcagtgtcatgaggctagctgataaaacgagacgcacrgtagttcagtatttaaataacccacggtcggtggtagttcatccttttgccgggtaagtgtgttcatgttttcctaagagcttgaaactgtatgtcttttacagtcattgaaaagtgatgccctagggatttaggtaagttcagcaaatataagattgaactgtatwagttgaaatcaccttaaattttatttcttttttcctccraaaaactttattctgggggagtaaaaaaaattgtttttaaacccaaaacatttcttctaacttttggctttctcagtcttcactgaagagtagtttttttcacagttgcagaggaccaaacaatgtgatatagattcagtagaaaaggagtgaataggcaacagaattaacaggaaagacccaaattctttccctgctttaatatatttatataaagcttagcaaaacttgcttaatcattcagtagttttcagaataaaaagtttttcagaccacaaagtttcatgttttaccattctataattggtggtgccagacaaggaaagacagaagagttcacagtattcctttttggttcctacttttcttatttaaatatgtttaacagctactgtgtttatttagaacaaatctgagctatgtgttgtatatgagtggaatgataaaaaagatggctgctaacccaccaatgcctgattacccagggaacatccatacctgttcttccgttagatatataatctcatcagcttccaaagctagtttgtgaaggaggtatgtgtaaatacccattttagagagaatgaatctaaggcgcagtgagataaagtgacttgtgaaagggcccgcagctattaggcaacagtcagtattcaaattccagacctgtctgactggaatgcctgtgtgcctaaaaaagtctgtttgctgcrtctagagtatctgctttaatttcctctctgtaagataataaaagaaacacattttaaaactgatgttattattgataagaaatttcattgccctatagagagttaaacagtttagttttttaatgaatttgtcttaactcaaacttttggcctttggttttgaaaaactgttgaattcctttcctgatgactcttttgtttaaaatgatatgaagtagttacatttcagaaagttacattttggaaaagaataattttgattcctctggatcccataaaagagaaaaagttgtttttttattttcttttgttttttttgtgttttttktttttgtttttgtttttttttgcctctagacttatctttttcccactctttagaatattaaaaaaatgcttgggtcagatactgtttgcattgcattgatttggatgctttcttcatctgagatgaatggtttcctgcaaatttatcaattccttatggaagaatgactagaggatcctgaatgtttaatctagagagaaagagattgaaatgttttcttgctctgttcgttgtttattattttattttaataacgtggaatatttaataggtaacctgaattgtgtcttgttagagaatatgttaggcgacaatagttttagttcctaaactctgagacagtggttctcttctctcaatgcccatttaaatgccatttgtatttgtgactttggttacatgttaactaaattttaactgagaattacatgagttatacactaagtatgttaagttcaatagcatataaagaaaacaaaattaattgcagtatctggagaatctctgtttgttctaaatctctggaagtcatgtagtttgtcccagtgttaacagccttaatttactactgctttttctaggtatctattcttcactgattggttccgtcctgctaaaattatgagagcatggagtgacggatctcacctcttgcctgtaataaacactactcttggatggcccaatggcttggccatcgattgggcgtaagtaggaatcatcatccccgatacttagttctcttttactgcagaacacataatgaggcaggttgggtgatatgatggtgtaaggaaactggtactgcttgccctcgcggaattttaaataattaattggtgatgggagaaggatattgaacaagaacacaaaggacataaacatagttggccagctactgctggggtgaaaactaataaattcatgagtattctgagaaaattrctagagaaagctgaatgacaagatttagtggaaactcaagatgggggaggtgggtcccaagcagcatttaaagtagggtacagatttgttgaactgtaggcagtgtgtaatttcttacagggaacatcttgagtttaggaaatctttggagtcaattaatcaacaaatgcacctttgcttacatgcactttgggaggactttaaaagtataagctatggttctcaagaaattgatgatctatctaggaatataggaaaaggaatagagtaaataagcttataaagatgaaatgccaargtaacttatgggagaaaaaaagggaagaaatatatttcaccttttaaacatagattactaccamtgtttttcttaacttgttgatttcacaaggagaaaataaaatttctggctcaaagatagcaacattttaagttttctaagacaattgattgaaagccacttcatgaaaagtagccgtctctttctgggggacataaaactgttaaatttttaatgaatataatttaaattttaaaaactttgtttaataaatgtgtcaactgaccctactgtttttggatgccctttgtgtaaagggtgctctgatagtttttggataagagataactaaatattttattattttagtgcttcacgattgtactgggtagatgcctattttgataaaattgagcacagcacctttgatggtttagacagaagaagactgggccrtatagagcagatgacacatccgtttggacttgccatctttggaggtatgttttaaagcaataaaagtatgtattgtttttatacattgcaagttacaatagtaaactcatcctcatgtggcattttcacaatcccagaaaagctggccactttaaaatgaaaaaatttaaaatggtgctatatatttagacaaaacatttggtttgttgatggtgtatttcatttttagagtgtgatttttgttttgtatatattcgtataatgttgacagtgtatatgggtacagcactttgtagattacatgtattatacaattcaacatcccaagtacttagttatacaagtatcacgtgaggaaacagtaaattactgccttcattttcaagaataaaacagcaagagctgtttatagtaatcattgtagcatttcattattctccagtgtttgtaagaatctcattagaaatccttgtggaaaaaacgattacacatattcatcaactatatgctgactgaatgactttgaaacttttttattcaaaatgttggagaactgacatcrtctttgttttatggaagtgttaggttatgctttatgaagaacagcaagacataattttttttcgtcaacctttccaaataatttcatgctactagtgaagattgctgagaagcatgaattctggggaactacagtcacaatgagcacagccartgcttgcctgtcttctcagctccccatttgagtgcaggcatgctgctgtgagttgagtttctgggaataagaatgtagcctggtaccatgaaacaggtggtttgcttagtcttgaaaacaggagctctgtgaatggttgtatagcttgtgcactgcataaaaatgccaggccaagagggtgaggagacactgaaatctatcctgggtctgtttgacaaaccatgattactccagttagaggggtcatgttttgtttaagtctaccaaaagccctgtgtatatgctagttgtgtccctggttgaaacctcctactttgaataattaacacagtgcttgaaaagactagacactcactataaatcaaagactttctcacatgcatagaatgtatgtgtggaatgaatagttagtaagtatattgcatatcttgtcctgctgtctgtttatctgtggaggagtgtgtggtatttaaaaaatgctcatgagatttttgatgagttaattataaatactcctcccgtccccctcccgccgctgccatccatttactcccttttcactaatgatgtcagacacatgctatttgctgtcacatagaaacattataaaaagttgaattttctctgctctgggctgggatgttttgggattcgagaaaatgtagttttagtatcttttggtttcatcagtatgaaaaaaatttgaatgcatacccatgaggacaacacaacattcccaaaatagcaataattatttatttctttcaacattgctgtttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcrgtgtttggttttttgttcttgcgatagtttactgagaatgatggtttccaatttcatccatgtctctacaaaggatatgaactcatcattttttatggctgcatagtattccatggtgtatatgtgccacrttttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggnnnnnnnnnnnnnnnnnnnnggaaatgcagaaatcaccgtcttctgcgtcgctcacgctgggagctgtagaccggagctgttcctattcggccatcttggctcctcccctcaacattgctgttttttgtgaatttcttttggaaagttcttttgttgtgcaacaccatagaaattgtgtacctttttactaaagggctagatcttcttgattgtgcaccacacagaactaaaagatttattgaactccttacttatttaagtatatgaggatgcctttgttagtagtgggactgggattgccaggctctagaaagatttagggagtccaatgactgattggtcattgattagaccacagataaggaaattggtcaaataaaatttatgacatcttaaacattttctgattaattagggttttctagttaaactatcattaaagagaaaatccacattgatgcaattctttcttttaaaaatatatgtttattttcctgctgcaatagttagtgtaaagtgaacatgattaaatttttgttgtttagaatcttatgtcgcctctctcttaccattgtgagcatcattctaacattagtagtgtggttgtaggtgaatccacacttgtgttgagatttttattgatcctcaaacatacactgaaagttccttttttgggctagacctgtacttttccttctcaacagcttcttatttaagtcaagggaaaaaaattacaatttaagcgctgtcattaaaacatagaatatgaactgtttgacctgggaaggatctcaggaatgattcagactgtctccttcacacagcgtagtatttgcctaagagcactcagcaggtgagtgctttagcgggtgcagacctatgaggcctcatttaatgctctgtagaagaattccccaattcttattttcactattacctatgcagawctaaatccaattgctactaaatgccatcataaaactccatatgtgcttgcctgaacctgaaccctgatattattaacatacagacttccacagagcattactagggagtaacaagtcgtggaaaatggttagagaaacatattacagatatttatgggggagatgatcgtacttgcaagaagcatttcaarcctattgcattttctcaagtgatttatttataagttagctgtgactgaaaatactaatctacccatgtttcttttcagagcatttattttttactgactggagactgggtgccattattcgagtcaggaaagcagatggtggagaaatgacagttatccgaagtggcattgcttacatactgcatttgaaatcgtatgatgtcaacatccagactggtgagtgagattgcccagttttttttatttttttgtatgggtttatttatttgttacagtggctcctgttctctttaagtacttattacttaaaggtctagctcctggtagttttatattcttgtcgttcacataatctaagagtgtaagacttgaaatctctgttcaatgctgctagccttaaacatgttgtcaggaaaaacacattttgggacttttccatacctaaatggaatgttgtatttggcgggttgatttccaagaggaagctactttttagtattgggtctgaaaaatgttttgtcctgtttgttttccttcacaaatcaaacccgtgacctacytagtgaaaatgtacatgactgactccctcggggctttgcttttgcaggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaacmaatgaaccacccacrgagcagtgtggcttattttccttcccctgtaaaaatggcagatgtgtgcccaattactatctctgtgatggagtcgatgattgtcatgataacagtgatgagcaactatgtggcacacttagtaagtagctatgcactggcgatatttcctgggatgaatagagtagaggtgggctttaaagaaaataaataaaagcttgggctatttatatgggaaaaatatcttttagaatttcagattcttaacatgcactttgaaggyttttaggaagctaagcaagaaatttcattcataatgttatggatggtttctggccttgatttagactatcttcaacaatwtttttccttgacattggctgtttggaccaatgcagtcattatgtcttggcaaactcctcaaaaagtcaaatcgaaataaactagatctgaccaggcaaggtggctcatgcctgtaatcggaggccgagacaggaggattgcttaagtccagaagtttgagaccagcctgggaaacatgacgaaatccggtctctacaaaaaatataaaatggcacatgtatacatatgtaactaacctgcacattgtgcacatgtaccctaaaacttaaagtataataataataaataaataaaaaagaaatagatgagctcagaaaaaaatatgtatataaaattacaaatagctgggactattacaaaatacmaaattacaaaatacaaaaaaaacaaaattacaagtagctaggactacaggcacatgccaccacacccagctaatttgtattttgtattttcacaaaatttgtaaaatacaaaaatttgtacttgggaggctgaggtgggagagttgtttgagctggggaggttgaggctgcagttagccaagactgtgccgtgtacttcagcctgtgcaacagagtgaagccctgcctcaaaaaaataagcaaacaaacaacaacaacaacaaaaaccaaaaataaagtagacctaacatttagcaaccgagagaatagtatcacagaataactacttgcaatcatagcctttggaaaatctcatgtgttatattccttttctcccatgttagagtaaaataaattaacaatgaaatggtggtcttaacctttatattcttcttttgacggtaatctagtctatatagtttggggcctaataaacactattgcagaaggcaaaagtattacattcaaattaaaaaaaagatagaggacagttgaaatctcagaaatctctatcaaggtgaagttaatactaataataacctttcttttggagagaaagaggagtgacagatttgcaagagtaaagtgctcacttgtacatttttctgaaattttttaaattttcatctttttgtgtattatcttcttgtttctaagagcacagcattttaccttaatattttatctatttgcacttttcatatgacatattttcaagctttctatagtctgaatttgaaattgtggttggaggaagtaacagcttgaaagttaaggatgagctttagagtgaatccaaccagagcgtgaatcataggcaggttcctaaatctctcaaagactcaatttccttatctgtaaaatgcagacaattatatgtactttatagtattcttgtgaggatttaaagagaacttatatgatgtgtgtgggtgcataacttagaaaaatgccttttctatgataaataccaaataaatgccagccaataatgatgttagtgatgatgacatcacttgatgaacatttctccttattatatacaatgcctccattaaaaaaggtgaactgagcctttataaggcaagaactcatttaaaaggctgtaaaaacaaatgtcttcatgaccagtttgttactattgtagataatacctgttcatcttcggcgttcacctgtggccatggggagtgcattcctgcacamtggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcagtaagttttgagctggtttcccttggttggtcagcctcstaaatagwcttcaacaaccaaatggccttgcattctttcctctaaggctcatgcaattttcattgtctctttagtacttctattccacttgtcaatctctgtgtcaataggttacaagaacaaaggcacgtgcctgcacatgggattcttagagtccacctacaaatattgagttctatggaagcaaagcaaggactgcctctgatgccaaacatttcaattcagataggaattgaaaaagtgaaaatccctcagctatctatttatatatttaaaacaatactaaaagtcatatagatatatccagacctttggctattgatgtttmtttttcatttggtacaagcaaaaagacatcaaaataaagaggcacagaaaatttaaatttcctttgatcttatccacctgttttccatcttgccagttctgctttcctttagcttgttgttttatttcatgtcttcaataatagtttaagatggagcaaagttccctgggctaagttctagtcctggttgcctgactaggcaagtcactatcatttggaatagatgagctttaagatcccttctagctttcataccctataagtgtgtatttaatataatttcatgttgtgggtggggccagccactgcatccgactccaaggctatggtcttaacagtaaggtaggaccctggtttttagaattgttctgttcagacttttaaatccagttttgggggtctgtctacacactgttgctactaggcatgtgggtcatgctggttttgttgcctgattgggctccattgcttggckttggtctagagtcatggacttcatagtattcatgaaatgtagtccaagtccaagcacatgatgctcactttctgaatgtggtctattttccaaggtgtaatcacagtttctgactctgccctgtaatctttttattctcaattctaaaacctatcctagttttgagttcttttgcttagctgactttgatagtgtggctgattcaaaagaattttgaacccatgtacaattgagataacttctgtagctatttagccatttttagtttggctctggtacttgttgcacaggaaataaacttgttggttttgttttcggatgacattagattcgacagagacatgccaacctagtcagtttaattgccccaatcatcgatgtattgacctatcgtttgtctgtgatggtgacaaggattgtgttgatggatctgatgaggttggttgtggtaagtgcattgcyttcktttttattcacaatgtttatttagaaaaatctcagtgttaacacatggacacagggaggggaacatcacacaccggggcctgttggggggtggggagctagagaagggatggcattaggagaaatacctaatgtagatgatgggttgatgggtgcagcaaaccaccatggcacgtgtatacctatgtaacaaacctgcatgttctgcatatgtactccagaacttaaagtataacaacaaaaaakaaaaatctcagtgtttagtcattttagccctgagctaatttctaatgcttttctctttcattcttagtattaaactgtactgcttctcaattcaagtgtgccagtggggataaatgtattggcgtcacaaatcgttgtgatggtgtttttgattgcagtgacaactcggatgaagcrggctgtcgtaagtaacacatacccagmatgtttcagacaaaggggtcatttcatttttgccagtattgatattgatattgccacacattttccctaactcagacaaactgggggaaagtatcctcaaaggaatgtggtattgaacatacagtaaaattgagtagacattgccatataatgtrtaattaacaaatcaagtggttgtataaatggacacttcaaatagtctcttagatgggctaaatatttcttagatatttttgttttcacttttagtttttcttaggacttcccactttagtaggtttaaacttttgaggctctactccatataaagatattttactggtttcttttaagtktcagtagagaagtcatatcatggtgtagaaatggtatggagctgtgtttagtattgactctgatgaattcattctttgtgctattatgtgttgaatatctgctaagatgttatctatggagattatagaaggcaagagacaattaagcaagatagacagttacaagggtcttagaaatggcacagataaaattctatggaggttcagagaaaagaaatttcttctagttggaggattcaagtaggacttcatacagtataattctgatggatctataatcttcacagactggaaacctatactcacatgatttgttatttgcccactttttgttttaaatggattttagacttgcaaaaactcatcagtgagttgatcatttgtttgaacaatggtgttttagaccaaaaaagtaagttttcatgaattctcctcctgcgtcagaaaggtagtgtgtaaagccatggattaaaaakaaaagttaaataaaatgcttatatactttatagtttgcacaacatctagaaattactaatcactaattttcctgtttcacattaaaaacataaaattctgtgatgagctgaggttaaactgtcaattgccgctggcttgctgttgccttgtgagatccctggtagagagttttggtttacccttgtcaaatagggaagcagttcttacgtatctctccaggattgcttgatgaatagtggaaagtttgcaaagaactgagtatttaccatcatctttagttagtgtgtgatggtttcattaggtatagttcatctgagggaaaataataacacccaaacatgatatgaaacacatgaagttcaaagtaatcatagctatttaagctctattgtaatgttctggtgattctttcatagaaagatagataaactttattattgaatctgcaattggaagtacattaaaaacacaggaaaaggaaacaggatgttcttttgacacaggtactcatctgctagtcagcagttgtgcgttctgtacttcgtttgttgtcagagccactagctgccacaaagaaatatttctatgtactagagtgtgggagaagactctatatcatttagccttaaatattaatttggtcatagttgttactataaacctactattggatccaaaatcatttcctctgagtctagactatraaagggatcacaaattacattcacaagccgatttaccccatgttttccttctagcaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgmcaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgtttcaaaaaatgagactaaattgaggccattagattgtcaaattaaatttggttctgttgktaatgtgctcattaatttttctaactttaatattttctaatttcaatcagaacttatcacaaaaaaatgaagtccagggatttgtgttgctgtgattaaagtgctgtgattggcatgtaatcctaattactgtcatttctttctttcctctttaatcaatgctcactctcagatgaaccccagccaggtatgattgtgaagtatttcagattcttatgatttcatatgtgttgtgtttgttctgaaaatgtcctgattatattaacttacttccctttctaacgcatgttctgtgttatgactcttacaaatatgttagagtacacatggaaatagaaggcatttgcatcyccaggcatgtgaactgtcttagggtggctttaggcattttcattttggccctgaaagtaaggcatgacgatatgttaccggatctgtgtactctaatatttcaatgacctttcccctttgatttgttcacttcatagattttctggtcttttctcttaaatgtttgtctatcttccatttctgtatagatagtagaatttcagaggaagaaaacgagaaacaattttaagtgtctttgcatgctctatcaatgacacttttcttccttgatgtcaacaatattttcccaagggttctcattgcattaaatggagttatactattgggttgtagtgaagaaggtgatcatactccaatggatatgaaggatggtaaatcctcagacaaattagagcaaaccctgaacagcctgtggaactcacccaagtgcatgctgcacttagctcttgtctgggcatcatattgaaggtggcatgagactgcataataaatattgcataagagtgaatcaaagaagcaaagattcttgattttcttttttcattattctctttcttttytctagatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccgstgctcgtgtgatacaggctacatgttagaaagtgatgggaggacttgcaaagttacaggtaattgctgaactaaccygagccagtttatcagcacatcccagagcttaaaatcaaatggcacatgtaggtatttgacaatgttgattaggagttagatcgacttgaatcctggaaagattatgcaatctctttaaacctcaattttttgtgaggattaaatggggtaatacacattaaaatcctggtgtattttggaaaatagaggttaaaacatatacaagtcaatgatttttaaagtatttaaaataataccaaatggcttttatataatttaaaatgagttctatactatatttaagcatctttatataatgcttaattgaattcaaccagtattaattcaatttctgctataagaaagtgctttttactatgtattaggatattgatttgaccactttcaaagtgaccaaatagaggaagctaaaacaaaaacagaaagtttctttcttttacatgtagtaggagtctggatgtcagagagtccagggcatggggtctgctctgttatcctcatcatgtggcttacatcaagggttccaatgctccaggttttagcttctcttagaaagtaggaaggggaaagagaaagtggagggcaagcagcttcctttttagaatgtgacctgagatttgattcgtaatttctactcacatcctattggtcagaacttagtcatgtggtcactccaaacttcagtggagggagagaaatgtctctggctggagagtctgtgccaagctaaaacttggcatgctttattactaaaaagaaaaagaagagagggggtgttgggagaattagaactctctaccatagctgagggcctcagaaaacagaaatatttaagacatgattcctgctgtccagaagcctacaacctattaaatagtaaggaagataaccaaagtacaaaaatraatacagtaaaaggaagaatgtaagcatagtttactctagactagtatttagaaacacagttaaatataacccaagaaagagtctattttaagtactcatgaaaaccagctaactattaaggttaagaatgaagtgattaaaatcattcatatggggcttcctcccctccccaccaacttactatagtttggaattacaccttctttctgttaccaaaagtattgaatcaaaagttttaaagagttgttttgtgttttctcccagtatcattgacatttttgcatttttttcttgaacagcatctgagagtctgctgttacttgtggcaagtcagaacaaaattattgcsgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtaagtacatttctgttgacctttggcctggctagttcctctgtcttgggtctgtttgctgttattcaccagtgagagaaggccctacctcatctgggtagctctcatggtaccttctgggccacatcatacccaagagacttgcgtgttcataactacgaatttatggctgttttagataggagggtggcctctgaatgcagatgtgtgattctgaattccaggtcaggtgatgcagagacctcacaatgtctttacggttccttttgcagtcttttcttgtggatgagagcagaggaaagtgcaggaaagttaaggggttgcttttcttagctttaatttagtgatatttctcaatccatctcccagaatttcagtttcttggctcctgatagttacatttcctctgcctcttacaactttattttgtarttcttggtccttaattaatagagatattattcgttgcatgcaaacactataacattttgtaatgttgccaactaagcaaatggatagagctttttcttaattgcaaaaacttttgaaaccaaaacgaaactatgcactaaccaaacaatgaagtcatcttagaatgttcagtgtgacaaaatcttgtatacttttctcagaaaaccctgctgttgatttggtggttagctacatgaggagacaaaattttctaatccccacaagtaattataggacaagttagatggtttaatctagatttttatataatatccatgtttgcattcatttatttgctctagaattcactctttattcacttttgtctttaggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaagtaagacttttttttaaaattatgttgccttgacatggttatgatgagggaaaaacaacagtaacatgatgtagctgatatgcatgttgctgataygcaaaatttaaaatgatcccttgtttaaacatggtaggtgtccaactgggtgttgctatctctccttcatctgaatcatcctcttcataaagtacataagagcaattgattgtttactttattttaagagcacattgatttattagcttggcaatacaatttttgaaatgtcatataattaaaaattaagtttctaattactgcatgcagtaatagtccayagaggggccagtttgatgtaactttgataactcatgattatacaacaaaaaagctggatttttctgcttcagttttatgttgtttattagagctcccttttaagtcatataaggaaggcagtttttgcctgctgatcctgaagggaagatagagaaattctcccatgtgtttggaaatctttgaggatttctttccctgaatttacttatattttataacttagattcttttctgcaggatggtaaattaggcaagttatgttcaatgtgatgttgaattcctagatattgtaaagtattacacaccactgaaatttatgatgaattcctgatgaagaataaattgatttccttatctaaaaacatgacagggtagacaaacaaggacagatggatttttctagatcaactatttgtggattataaacaaacatgaattggcattgagacatttcaatgtcataatgtactacattatgacattatgtattacatgttttatgaacattataaaaatacccagatgggttgtgattgtgttatgacagttttactttgtgacacttagaggaaacaataaactctgtgaatatattctgaaccagagatgatttattttaagcagggcataaacaggatgwtgtattatttaaaatgacagttatttttaatatttaaatacgtcccctccaaytggtaactcatttcctttcccagtgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgygattataatggacaccatcggagacaggtgatagccagtgatttggtaagttggtggtgaggaaaaccaaattaaaactacagtcgtggataggtagaaatcagacgagtatcagaaaagctaagaaattaatttttgtgtcatagacattgtcagatcaatccaggaaataccagcaacagtgagaggcagtctatcccatatgactaactggaaaatgaatattttcattccagttcatggtcagcttgtgccatatccaggaaggatttttatagctcgtgtgatttagttgagctgcagatgtgaatctgttgcttctatacctttaaaaattgtgtcaggtggccgggcgcggtggctcacgcctgtgatcccagcactttgggaggccgaggtgggtggatcatctgaggtcaggagtttgagaccagcctggccaacatggtgaaacctcatctctactaaaaacacaaaaattagccagtgtggtagcacacacctatagtctcagctattcgggaagctgagacaggaaaattgcttgaacccgggaagcagaggttgcagtgagctgagattgcctcactgcactccagcctaggtgacagagtgagactccatctcaaaaaaaaaaaaawtttttttcaagcaaaaatttataacttaacttggccaggcacattgtctcacatctgtaatcctagcactttgggaggctgaggttggtggatcgcttgagcccaggagttcaagaccagcctgggtaacatggcaaaaccccatttctacaaaaaaatacaaaaattagctgggcatgggggtgtttgcctatagtcccaactacttgggaggctgaggtgggaggattgcctgaacccagggaggtcaaggctgtagtgagctgtgattgtgccactgcactccagcctgggtgacaaagtgagaccctgttttcaaaaaaaaaaaaaacaaaaattaactagatttayatttctcagtcttgttcttcacataacattttttattctataaattctgttgaatttattttcacaagttaaatgggaaaataaagaaaatagataytttatcaaagagctgttattgacccccattaaaaataggaatgcttttacactgttggtgggagtgtaaattagttcaaccattgtggaagatagtgtggcaattcctcagggatctagaaccagaaataccatttgacccagcaatcccattactgggtatatacccaaaggaatataaatcattctactataaagacacatgcactcatatgttattgcagcactatttacaatagcaaagacttggaactaacamaaatgcccattaatgatagacatatacatcatggactactatgcagccataaaaaagaatgagttcatgtcctttgcagggatatggatgaagctggaaaccatcattttcagcaaactaacacaagaacagaaaaccaaacactkcatgttgtcactcataagtgagagttgaacaatgagaacacatggacacagggaggggaacatcacacaccggggcctgtcagtgggtgggggcaaggggagggagagcattaggacaaatatctaatgcatgtgagggttaaaacctagatgatgggttgatgggtgcagcaaaccaccatggcacatgtatacctatgtaacaaacctgcacgttctgcacatgtatcccagaacttaaagtaaaataaaaaataaaaaatwaaaaacaatttaaaaaagagaaaaaattgctattgtatagttgctgtgacttgaaggaaagatgcatctaaactataacagattgatgtgaatcagtgagtggcagcacaagaccgtggaaatagccggcacaagtgtgctgatggtggagtgaaggctggggcgtgggagtgggagatgaggagtctctaagctctctagttccatctaacttttaactagtaggtgatccggatacatcaccttgctttttgtgcttcagttttgttttcatttgtaaaatagatgcccagtgtaattaccaagrcaaacataaagagtaaatggcacgtgtatgtgaaaggctcttgaatggtttagtgggatataggacgaattgtgtattttttgccgctcttttgcacaatgacttccttgtgtttttattaaataatgacatgttaaaggaaaccgtcttcttgagcagatatcctctttgactcagtgcaccttggctttsatttttggatgaggtctcactgttctcttctgcctcacagattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattgtgagtgatacagagaaacatcctgcctgggagtagcttgaaaaacactgaccctgggaatgctaaatgyacactgttacagacccatttgtttggrcaatacattttccttttctctttacaaaccaccccactatatactttccctagtcctgacattgccattacttttatttaccatggaaatttcaaacctaggatataataacagcacatctgaattatatcatttcagcatttggctgctacctctktgaccctcacatgagtctcygtttcctcagctgacaaatggagtacagaccagatagtgccttcgatcctcttaccgctaccactctgattgaaagcagcttacttttaggactagtttattatggcaccactgccttctaggtgctctgctgtagccagcacgagttgtcctaaagtgcatggtaygggtgtctaggtgaaagacttggcatccgtactgttctttctggtgggagagggagataagtcacttartcttcacttaatcctctctcctcaaaactctccaattgtttctcacacccttcagcatgtggctgctgctatttccctgctctcttctcccactcgctgttgccacattggatttcattatggtccaaaagcacagcaggcgactcctgcctctcagcttctgcgctagctcttccctctrcctggaacatctctcttccagatctctgcatgagttgcttcgcgtgcyatttaggattctacccaaatgtcactttctcagagaggccctcattgaccgctctacctaaaatagccaccccctcataattcttttgcyctttaccctcatgttctgaaayctctctctctctctctgagtttagttgtttctttttgctcgaatatatactccacttttatagygtccccartgcttagaatggtgtttggtttacagtgaatacctaccatttttctggtgaatgaatggattaataatctattaataacatggtatgtgtaataaaaatgtataggatctaggaaacatcctgtgtgtggggaccacacagaatcctgattttcaaggtgcagagacacacagagatatcatcagtagaaaaataaaagattattatctaaccaaaatctggaaaactctaggtaaactacaaggtcacacatcaaacacacaactttttttttttttaatgcaaaaagatctcttttaggtcaggtaaggagacagattatttggcatcatatttctattacaagttccagattactcagtggctgtttgttcrtaatccagttatagactggattgatctgtaaccttgagtcattctcctctctcgtgtctcttatgaattctaagttgaaagcctgatgctagggaagttgaaagtgtgagtagttcrgtgaaaacaaaacaaaagaaaacaacrgrggtaacaacgtacttaagcmcccctgtactggggcctctggaaggacactaagagcatgactctgttttgattttaatgtggaggttttccacttactggtgctttcttctctttctcatgcagcygtgaatccatgtgccttttcccgctgcagccatctctgcctgctttcctcacaggggcctcatttttactcctgtgtttgtccttcaggatggagtctgtctcctgatctcctgaattgcttgagaggtatagtatgctccttatgtgagctctgaagatggagctggtcatagtttgtgccaagcagtggaaactctaaaaccaattgcgactgaacatgtgctgtgtcctttgattcctcaggtgtctgcagaatgatgtgtgttgtatggggtgatgtcactgtgtgccttggttgtaatayagtttctgtatatggaactaatgttatctgtgcatgtaattgaacaatctgtaacctcatattttctctcacctgggtacagttagacttctctgacaagccatgataatgggaagttccaaattcttcacctaagaagtaaacattctcaaygtttgtgtacagcttcattttttatgtccattgtctctttctccctcttttttttttyytttttytttctttyttttttttttctttctgagacagggtcttgctctgatgcccagactgtagtgcaatggcgtaatcatagctcactgtagcctccactttccgggcccctgtgattctcccacctcagcctcctgagtagatgagactataggtgcacgccaccacacccggctaatttttgtattttttgtagagaccgggttttgccatgttgcccaggctggtctccaagttctgccctcaggccatccacttgccttagcctcccaaagtgctgggattacagacgtggaccactgcacctggctccattgtctcatttttattcttataaccaatagttaatgagtgttctagcctgggtcttctgactccaatttcagtactgttactattaccatctgatactttaagaaggagaattgtgttggtatgagatattacaagtgactgagcaatttaatatttatctcatcctagagatattttattgggtcgattgaagagtgtgtggaggattataccaagtacttaagggagtaagaaaagaaggaaaagttgcatccagttcacaaaagagatttcttctggagtgtgtacttgtatataatacacttaaaaatataattccttattgcttaaaaatctaagaagttactctaaacccaagttccctttcgtttctcagtgaagagaactgaatgaatatattttgatactgatgaaaattgctgtagacaagttcaacttaaatgtttaatgatcacatattcctaaattaagagataatagagtcctaatctagaaggaaatttagtcctaatctagaatggaaaatatatactgaattcaggaaacttttagtgtttagatattatgcagatgtaggcttactgaaaatcaaattccatcagcatgtaatattgtgcaatgatactttcatgatgaaagattttaattattggtaattctcacagagggactggcacttgccatttttcctcagagacttattatgtacctaatcctcgttgacattgtttaatttagtgtgttcctagagtctttcaggagaagattaaactgggctgtagacatttcggatacaaagcattctttcagcacacaaagactgttgaattgcacattgggggttggtgtaatcaatattactctctgatgatgattgataagtgttaattttaaatagtgccttttgttgtttcacaaataattccactagtggttttctcatgggttgactttaccgaagtggaactttttaagtatttcccagtaggtttcagagcaccagctgagtaactgattgccaatatatgttaaatgaaaaaaggtttccacatttttttttccccaacaagaagtttagaaaacttgttaacatttataggtggaaacattttacttgatttgattgttgaatagcttttcaactagtgtttactaagaggctggaatatatgtagaagtgcttctgtgatgctgttaagtaaaagaagcagatattgcacaatattggccttgtaaaaacatgcattaaaaaacacacaagtttctggaagcaaaaacacacaagtgccaatagtggttacagttggataggggaattatgagatggttctacttatttctaattttatgttataatgagtgctttctctgtatgagactttttaaattctttagaaaatatattccccacaatgccaaaaccaaatgaacaaacaaaactcaagccaaacatcacctcagcacccctaaaattactccaaatacaaatagacttctgactcggtctcaggggcacaaggcacttgcttcagtgattttgtgcaagataagagaacactccttgtccttgctccagggaaggctgcagtgctgatcagcttgtgcagggtatgacttaaggaggacctaggtttgggggtcatatatattgtcgttcaattacaacactgagttctcattcctgactatagtgtcttcatgactctgctgacactaacattaatgggattatgacatggaaaatagaaatgaagagatgatctttaacttcaaaagacagagacacactgacctacttaaccgtcaccacctcctgaattcctttccatccaaccctagatgattctgtgcctaccccttcatgccattgtcataattgtaagggctcatatacttggtcttgccctctagatgctgcgttccttgaggataaagcctctacctggtctgtagatgtatgcttattgcctgtggcacttcrtggtacatggtggcactcagtaaatgttgagtgaatgacaagctctccaatatccatttttgttacttccccagtcctctgatttttacccgtttgctccgtagaaatgtgtgcagtgttgtgaagtcacttctttttgctttcccatatagcacttttcaggcatctccctgcgccacctgttgtcttactggccagttcctttctattactcccctggcatcatcccccaccatgatgctcacagtttcagccagcgcagcattgcaggagatcctgttctctggtccattgcttgcaaatgttcattggtggtaaacgttctcagtacatcagcagttatcagataaagggcttgagacatgatccccaggaagcagtagaagcgggtggtgcttaagggaagagcaccatggaagagtcaagaaggcccatgcataatggatgagatatgcaaagtttttaggccctaaacaatgctttggttgagaattattccaattaagcaaagggagatgacccattcaaaagggcaggatcagatcttacgtaagtgagtaaaaatttaaagtyccccataaaactgggacagagatagtttctactgagccagtgaacattaataacagataatcaataaataattaaatatcatctcaatataatttcttggtacagctgaaactcataatctagcatttttttttttttttttactgttgcagttaaaccaaatgaaatgagtggtaatttgatactcaagaaatagtacctggcctgcggtatttgcagtgtagtgatgaaaaacgtagattttggagtccaggagtcctggttgtgtgacctcgtttaaattgcttgatttctttgtgtcttatttgcaaattgagggaggacctatctaacaaacaagattaggaaacttgagggagataaattaagggaaatacttacctgatgcatgcagtatggcgcatattctcaatcaatgagaagygatttttattgcaattgcagttgttcagaagagaggcaatgtggagcagctgagagaagaagggcctggaagtgaatgagccagggtccatctcctattactgtttcctgcagaagtcacagagctcctgcaaatctcatttgctccagctgaaaacaactttgcaggcttgttgtggaagactctacattgtagtacttgaaaaatgtaaagcattaatagttgcgaaatttacattagactaaatttaaatttgtcctaggttaataaagactgggttatttctcagtaatagaaatgataggaacaagaaaaagctaatgagatgtgaaaataagtaaagaaaaaatgaccaagtcatcctgctgaagatggaaagcttcccggattataaaaataatgaaaacatcatttttagcttatgaaagttgtgtaatgattaatcatttcatactttgtcttaatatgtgatatatcttatacatatatcttaacccaaaacttagattcaaaagttttccttttctcagagaggaattttaaaaccccactcttgatggggatcaggataaagattaaattatttttgaaaaaggaacttttattatctattaaggagataagtgaactgatagtttaagatattatgggaatgtttaaattacaatgtgtagacagttttgagaactttggaagatactgtttacttattcacttatacattcatccattaatgcagtcatatggtcatccatttagttakcaaacatttattgggcaactattttatgccaggctctgagtaccaggccctgggacacaataatgagcaaatcagacacagtcattgacctttgggagttaaaatcttatagggaagagagacactagtcaagtaacaactgataggattatacattggatttatttattaaagtctcaataaatactaggcaacactttgtagtgttgttttatttttggaacattcttaaaactagtaagctgcctttcacaagaatagtctcaatgatttttttcactttttttttttcaaaactcaactctcctttccctgagatcagtgtgagtgaggtttgtctgtgtgtagaagtggaagaacttcctgtctgtgaggtttagcaaacatgggtggtttattagtgtaagtaaggacttaatgaagagtaagataaataccaacctgccttgaaaaagtccagacagcgttgtatgtggggttggaggtcttgtggtccagcagcccactgaaaccctgggaaaggcccatgcttgtctgatgaagtacattatatttattgctgcaatgctgcaatgtcattttagcccatatgatggtaacaggctattgccttccattactctaaatgtctgggaatagtrggatatgattttgactgatattcttctattttcacagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccagtaagttttgaataacattcaaagtatataatttattcttgaagagmctgcctgcactgatgttttcttataagcaaacttttgtcatgtgagtaaaagggaaacaatgtggaaataaatttatccctaagttttttgattcaatgagggktatawatktgagcttggcctggagcaaaaatcataacactctttagcttcagaataagaaacaaatttaagctattgtgtattatttactcattcagcaagtattttccagaagtgcctatgatttgccctgcactgaattacctgcttctaaccacagaatacatgccaagaagcagcagtcacaatgcttgcccctagaggagtcttaagctagtagaaaatattcgacgaatataaaaatgatcaaaactcaagayaaaagtagtagctccctaagggaatttagtgaaagcatttgatgtggtgctggggccttcctttagaatcctttagaatatttgcctctagggtaagaatgaacacttctccagttctcttcctcagaggtcattttcttcagccttcagggaaaaaacctgtmagaatagggaaagagcaagaagactataaaggaggaagagaagaaaaatctttgtgtttcatgtttgtcacctatatacaaaatatactcctggtcttctgatccacatctgtgacttgggtttttctcatgacttgtatgcttgtggtagttaagaactatctctgtagccagtactggagatagcctgaatggtaagccttgtgtattcctgtgacacactgaaaaatcgtttgaagcctacccagtggtgctgaacctttgtttgcctttcctctgagtgtaaggactgttcaagaaatacagcagctggcagtagccacagtgaagaaagggttcttttgyaggagccatggccttggaactgctcacctccccttgtctttctttccagggtgaaattcacagagtgaagacagatggcaccaacaggacagtatttgcttctatatctatggtggggccttctatgaacctggccttagattggatttcaagaaacctttattctaccaatcctagaactcagtcaatcgaggtaatgattccataatactacttacacaaacattggatttagattgatgtaaactctagtctcaggaatagatctcacgtggattttggaatcatttttaagcaaaaagaaaaagggaaaagatattagtgttaactatcaaagtctctgaagtgaaagaggaaaaccaccttaaaattttttttaaatttatttttatttatttatttatttwttttttagacaaagtctcactctgtcgcccaggctggagtgcagtggcaagaccttggctcactgcaacctctggctcctgggttcaagcaattctcctgtctcagccacccgagtagctgggattacaggcgtgcaccaccaagcctagttaattttttgtatttttagtagagacggggtttcaccatgttggccaggctggtcttgaacacctgacctcaagtgatccacccgccttgacctcccaaagtgttgggattataggcatgagccaccacgcctggctggcaaaaataaattatttgagctttctattgctctattttgtttcctcctaattatcaatactaccttgttgctataaaagtrttttaggtaatttacaaaataatatataagaagataaataaaagttgcataaggaattcaacataaagggaagattatggtaagcagagaattttactatgtttcctcatctaatcttcaatgctatttcagttctcaaccaaatttatagtttgcctctgttcttagatggaaatctttctatggctccagtacagtttttctaacagcaaaacagaaagtagaaacttgattctaattcctttgatactctcttcttcaagataagtgttctttttactctaattcccagaagaaattctagatgaggcacaggtatgaaatcacatgaagtaagtcagaggtaacttgactagtgttggtttgctccactctgagagaagggtaaaacatggaagggattattaattcacaataattttgaaagtgaaacttcccaaaacaaggagaagtttttggagggggatagttagcagagccctgacaatccactgctttaggtgggcaccagctggcaagacggtttttctctggagcattcagaaagatactgaagatgagcaaggcgcacagcagcctgctggctaatttagagcacctatctatactaaaaagcactctctgtagactaagaacacrgcctatgtagagttcggtactatctgaggtttcatgcatcccttggtgatcttggaatgtatcccccatggwtgagtgcagatgactgtttttatttctgccaaatgaagaaatagggaaaaggtgtcccaggcagagaaaagagctctcactggaacagcgcttgagtttacaaagatctttcactagcatctaatttaatcctcacaacattcctgagggcaggcagktctggtagccatttgtgatgagagggaaatttgcagtgtgcacaagtatctcaagccaggtagaattatcaggtgttaacatgaagggccccttggaggctcctctggttcaaactcttttttttatttttatttttttacatcagaaaccaaggcccacaraagctaagaagatgtcttaaatggtcagcttcactgctctaattcctgagcagtattctctctttgcacttttataaactacaactccggcaatccagactggtttaaccctctttgacagtggcagaaaatatttttcatgatttcaactaagactatcatcctcccattaaacaggcaacatctactgcctaagacccttactaccaaactcacatctctctaaagtccacccagtgcaaagctgtcttaattccaaatggcaattaatatgctcttattttatctcttkgtctcttgattagtaaatggggttctcttcttttaaactgatagttttccaaaagcagggaacgtgtctttcccattagtgttaggtacaatgcagtagtggccagttggagaataactgagcgtgcatgtgtgtatggattggtaaggccactttaaccacatgaaccaaaagtttctaattatgccctgatgcagtgtggtacagaggaaagatattttgatttggagtccaaagacctggctttgagtctgggttgcttgctcattttattcattcatttaatgagcactaggaaatgctttctatggatcagttgatcctggatatcctaagatgaataaacattttttttctgtctttaagwagctcacatatctgtgagatggatacataaacaaatacctgtgctccagtgtcataagtgtgataaggccrgtgaatataaagtgctagtgattggaggcagaggtataagtgaggggagagagcatgcagatttcccattcatggttacttgtgagctgagtcttgaaagatgactaatacatccttscttatcggagggtttcactttccgaggtttcagttacctgcagtggcctgagaatatgtgagtacagcacaataagatatttaaaagggaggagagagagagagaccacattcacataattgttattacagtatatttttataattgttctattttcagattatggttaatctcttaccatgtctaatttataaattaaactttgtcataggtgtgtatrtgtaggaaaaaatatagtatatatagcattcagtactatctgaggtttcaggcatccattggtgatcttggaatttgtcccccatggatgagggggatgactgtttttatttctgccaaatgaagacgtagggaaaaggtgtcccaggagagaaaaacagttgaataaagaccctgaaacatggaaatgcattttatgactggggacaacactgcattttctccactcatgagctattcgaccttggacaaattacttaacttctctgagcctgttttctcatctgtacagtggagtttatggctgaggaagtaaaagtacttcataacactraggtatcctgtaaatacagagygctgtttccctcaaatgatcaatatttttagaaaatccatgaaagacctgtgagaataatgatccaagggcaaactgcccttttaatggtttaactggtgtttccccttaggtcatttaaattgtaagtaagtcttccaggtgattgttggattaattaagaaaataggaatcrtattcactttctgtttacctgtataatattccttcctgcctaagagtagttcgtgtttaactccaacttgaaaataagagaaacattgaagaaactattatccactaggggtagctgtgttcccatccactaaaagaaattttatagctgaattttgtagtgaagcctacagaatggccgtgtgagagagagctctatatattccagaaagcaagaaaaggaactgtgaaccaaagagatccttagtcttaggaaaaggagagagattgtagcagaaagaggcawaccgagaaaagaaaagctaccttagtccaagcaagagtgaaagataccagacaataggcagagaaaaaaatttagagaaaagaatgagggaaagaaggatatatgtgtgtgtgtgtgtatgtgtgcgtgtgaatgcgtgcacacacgtgcacacgcatgtatgagagacagagaaacacaaataatctatttgtattgaaaagcaattttatagaaaaaccttaatgcaaaaatcaacagacattttctaatttcttactaattgtctgttagactgtcttaggtacgtattaaaatagcttcattgctgtaagaaacttctttctagtccaataaactatatttctatgtgctgtatcagggccctgttaacactgtgattataacagtaataatcacagacagccttgggaaagccactaaacctctgtaggcctctttttctccatctgtattgagaaaaataatgggatctacctcacagaattgtttatgaggatcgaatacaataatgcttgctctaatacctcatatatagtaagtgaccaacagatggaccaattaaacaatagaagtttattgaacatagttgtgctgggtggtgtgctgctttacctgtattatctcttagtcccgtaaggtctacgcagaccttccatatttgactgataaagttcaaagaggtgaatttatttgcctcagattgtacagtcaggacctggcagggcagagatttcagctcatgtgtttcagtttagkttgttgacttggaacagaattcactgtacctctgagtaaatttggactattttgatcaactgtgttggcagtaactggccaccgagtgccttggtggggtgcaggaaagctgtggggttctcatttgtcttccagagatttctcttagctctcctgaaggatttttgcagtttctttaggcagtggctctgtatgttttcccaactgaatcttccttttatccataaaaatgttccctcctgaaattttaggtgagttggaagtaggaacttgggaggtgattttgctgctcttactctcattttctattgagctaatttcctcatttccctgaagtgcaatatagattatctgaatctcatgcaaatcctctctcatccatccctaatcgtgctttrgaatttgttttgtacataagttctccttcatctcagtttcctttggttccccttatgaaagtcagttctaataagtgattttatgctataggttttgacactccacggagatatcagatacagaaaaacattgattgccaatgatgggacagctcttggagttggctttccaattggcataactgttgatcctgctcgtgggtgagtattcataaatggcacgtgtcttccatgcagcattgttcttgttaatgtcagggtctgacaaaatggaagatttcaaatttaggacatcttctgatttcatatgtcaacatttgaaaaataatagatctcagtgagaaagagaaatagctctgacctatatttaatgtgcaggatattgtttgtattttgtcctatggtcttcaaatgaacaacactggatttaaaattaattccaaacaagcaagaattttaggaattttaaaatagcattataagaattgacaatatattctgactttgaaaggacacggaaagctctaagggattatgtaacatttgcaatagagcttgcaggatgagaagccttctagtaggtggagaatgggttgcaaccaggcagtgactcttgaggccaagggatccatgaaggcacagaagtatggcggcacttagcaggattgtggggagagccggaaccagaggcttagagtagggagctgttgaccacatgggagatacaacagataaggtcatttggggacaaatcaaggagggcctttaatatcatgctaagaagttgaactttattcttttgagtgataaggagcaagtagggattttttttaaaaaatttcaacttttattttagttatagggggcacatgtgcaggtttgttacatgggtatattgtacccagatagtgagcatagtacccratagttagtttttcaacccatgccctcctcccttcctcccctctctagtagtccacagtgtctgttgttcccatgtgtatgtccatgtgtgctcaatgtttagctcccacttataagtcagaacatgtggtatttggttttctcttcctagcaaggaatyctgaggaagggagtgaaagaaccaaattygtgttttagaaaaattggtcaggattgrtgtggagagaggccagggccagggagaccagttaggagaaaatggtcttaatggatgtaggctggagtcctccggtctgtttgattggctatttcattctgttgatctactataccatattataaaccagaataacaaattgtaaaatatgaacactgattttttttttaaagagattgtagcatcattccaagtggattttggcttaatgtttgaaagttatcagattcttaggcctagaagggcactgaagaagtaatttgtattagcgctctgtttcaaataaggatgacatggaaaccaaatccaatttttaaagggcacaagaagcaaacattctattctgtgcctgctggcttgtactagttttcagttattctttctagaagaaggactgtcttaggttcgaaattctacttttgaaactcaggctcactcattatttgtttttcgtttatcagacatttctgcattgtgtacctttgttgggtggtgtgttagttaagatagctaactgttgaagcaaataaactcctaaatatgtaatggctcaaagaaaatagaaatttttttgtcttttatatgggcagtggggtttgggcagaagatgggaggaagctctactctacgtagtcattcaggacccaggctgatggatgctctgccatcttcagtaggaggcttcctaggtcattctgagtatcaagatctttcgagcagtaaaggaaagaacgttcagaaatttgctgggaggtttttatgagccaggcctacaagtagtgcacgccacttctgctcacactccttaagctagaattgggtcacatggccacagctaactgcacggaaggacatgcagtccacctatttacccagagagaagaggaagacattaattttggcaagtggaggcagtctctttcatggggccatggtggggagttcagagggtggatacaaagattaaagacctaatttgcaaccttaaggatttatggcttagtaaggaggataaggcctgtgtataaataacaataacccagattcatataagattaagagccacaagagaggctaaaaaaattgggatgatagtgctataaagaggtgacatttcagcttggtggaagagatatcatttggactggatcttaaagcatacctagaatttcactgggcagagctagcttttaagatatatcaggcgatatgaaggatggaaggtcaagagcaaagggacagaaaattgagggtttgttcaagtgactaagagcaacccagttgggttgggagacaattagaagagcttagaattttgtcagaggacataggaggagaaacaagacagagacttgaggatctaatatcttggattctcagtgaagagaaagtcttgataaagttgtgataaatgttattgaaccagttgttgcagaaaaatatctttgtggatgatcactaataaagagctgaggcagttacagggtctctgatgatattcaagagaggatgttgaatagagatagtagaagttaaaagaatggaaggaggatgaggaaatgtgaatactcttttaagaattttgtattggaaagttagagaaagataaacttgtaggtcaaaatgtaacaggaaaatgtctttcagaatagagaaacctgagtgtattctttagcagcagatgaaagatcaaggatgaagaaataattgattgagagtgaaagttatggggaaggaattcgaaatttatgaagtagaatgacttgaaatagtcaatatgcggaacatgatataaagtctgctagggatgagaatcctcagcttagattagggaacttagatttttagtgaattcagaattcacgaaagttttgtgctatgtccaggaaactcttggtaccctgaaatgggagaggagaaagaaaaaaaagggcagaaacccagggttggagattagcttagacacaatgggaacccaaaagaataaataagaatattgttgaaatggttacatatgatgtccaggtgtagaagractggagggttgggagctcaggcagggcttaagggcaaagaacaagtttaataggaaaagttaaagcaaggaagaaatgagagkttttggtcgaagcagagcatttcagagtttgagaacttagaggcggagaagtttagagttgaagatgaaattcaaaggacgggtatattgatttggtggtggaagaggtaggtgaataaagactatttaaatgaaggggtttaaggacttttcagaaaagaatgtaggagaattgtctgttgaagatatagaaggaggtgcaatcaaaaggaattaaaagttgggttcaagtctagaacttacatcttcagtggaaatggaaaacagcccttaatatattttaatacattttcatatatcatggatttggcaatgctgtgtggtaattatggttcatgtgtacctgatcgctgtgaaatagaaagaaaaaakaagtcttccttaccccataacagcatgataatgagattccactctcacagaaaagtgttactcattatttctcctattttctgtgtcagttttcaaaattctttgcatttttcatcacagaaatcaggttaggtaattaagtagccggtcttgtggtagatggtgatttggrgaataattaaatgaggcctggtaagtgatcagggagtgtacttggcagctttttatattagctttggccttcactatgtactgaagatggagggattattgatgtaggtttcttccttgtcataagcttcccacacacctgaccatgctaaaagttcagctgccagtgggataccctagcttcttattccagacaccattttaagtggcctctactccagttatagctaggaaatataccgacattggtagaacactggtgaagtacccctccrcgttgtatgcaacragatattgattttcagcctttgcccattgtattgtgagcatcttgaggacaagtaatacacattgtcatttatgtcactgactcaaatccaccttctgttttgttacatgctggtgtttttcatggttgtaggaagctgtactggtcagaccaaggaactgacagtggggttcctgccaagatcgscagtgctaacatggatggcacatctgtgaaaactctctttactgggaacctcgaacacctggagtgtgtcactcttgacatcgaagagcagaaactctactgggcagtcactggaagaggagkggtatgagcaccctttcagtcttttggtctttatgctgagctggtgtagctgatgctgagtgttctgagctgtcaggcagtggttcttgaacaatcttacttggtaacttgtaccagtgtttcattgccccttctcccaataacttctctcccttgcacgtacctcgcccctagctgaagtccagttctttatagtatgtgcatagttccctatagggtaatgtttattaatttccccaccaacgtttktttttcttcaagataaattaattccatttgtcatttcttacttgtcatttcagagccatttctttcatggtttagtgatttcagtgtttttctttgaaagtactctgggttctccaattatagagaatatacatatacctatatatatggagagaatatatatataaaaaatatagagtatgtatctatactatatggtatatagaatctatatagattctatatatgatctatatagawtctatatatgatctatatagatatagaatatatattatagaatatagaatatatatttatagaatayagaatatatatctattatatatagaatatagaatttatatatctgtataggatataggtatattctatrtatctacctatgtgtgtgtgtatgtatgtatgtatctatttatttacgtagcaaggttctgaactcagcatcccctcgtagctacacattcttctctaatattttaacatgattaatgcacatgcgaaactttctttagtggtgattttcaactccaaggttgggttcattatattctacaataagaagcagaaactataaagtctcgttcactcattgaaataggatttcaccttcactgagctggggctaagcacatagacaatgctcaataataattattgatgaagcattgctttgggtgctgaactgaatatatgctagtcccttccttgctatttaacagtagttacttcagatcctkgacattgatgcttttcataatattgtgcagtaggtttggctttcagttcattgtttgttcaacaagtactaacttcactccgaatatggacctataatggtggtaagctttggagattaaaaagaagtgatgatgtgtgtgaaaacactttgcagagttgggtgcatgtgtgcaatgacgaggaagctcttgttacatggtatggtttctgtacacacatctgacagggcacagcttctaaatctacgtgcttgttagtggtgtgactctccaacctttctcctagtgtagttcccttatttctccttcactctcctggtttaatcatcaccaaatgctgcaatccatcctcagcctgtcactcatgcccagatcttttctgccacctccaccattctgagcaacctctctctggccttgactaggcatggccttcagtggtgaagcctgctttcatgttggagacatgttttcttcataaagccacagtcagcaagttggatcacgrctcagcttggagccttgccctgaggagtagctcccaacacttctgtgaggttgctcagctaatctggtcctggcctccactctctccactctctcctccargctcatgtttcttatattctaaattctagaactttgatcagtttcatcagcataaccactcttgtaactgctgggctcccttttcagccatggcwgtaaagccacactgtgtctctcgccaatacccagcccagatcctggcacagagcaggcacttgaggcaggtttttggagtgaaattaaaccagctacatctacatttcatttttcttccagaagaagctgactacttgtcattttcccttagggactttattcttgtagttcttttccagtgtaccaaagctattttgattaaagcttgttatctgttcaaatttaatggcaccatttttggccctgtcctgtcttgctgtcctctgtggttgtttgggggcatatttccaatctccattacagaaattgtcagtgaaggtgttaaactcagggtgagtcagctcctgtgcaatggcccacgcttagatgtttgagtatatccttgaccagaatatcacatgcagggactagtggtttagctcccttttcttcaccgtgccacctgaaaaggttgactgactcatgtgagctccgtcttcattatcaatgaaaggggcacagtgacattttcctgacctgctgcttggtgtsgttgtgatgatcaaatcagaaaatagaagtgaaaaatctctgtaagggatagagggctgtataaatgtgagacattataattaggagaatattagtgtttaaatgttcaaaattttcactatgaatccatgaaactaatgaaaattccaatcctttagattgaaagaggaaacgtggatggaacagatcgratgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacaracgcagtaagtatttgtcaytgaaatacattcatgggtgtataatgcatattcacacataactcacatttgtaagcacacacccacacacagtttcacgtacatacacgtgcatacaaattgaagttacctgaaatatttaaaaaatgataatgaagtcttaaacatggttaagtgccaagggctaatttggcatctgaaaggccagattgacttcagagtaagtttattccctttctcttcccattactttcaattccttactttgcttttrcttcatagaactccctgttttctattgtttgtgttacttattagaatataacctctgtacgggcaggcattttgtctgtcttgtttgctgctcaatactcggtgattagaatagtgcttggcacataaaaggtgctcagggcatatgagttggatgcctgctgggaaagtgctaatgggatggaatttttagtcttaaaaagaatgcttttggatgttgcctatttcaacatttttttcaaagataatctaatttctgatttacccctttaaattagtggtatgatacaggtattattttttgatgtattttatagctttcgtcttcagccaaagatgatcaaacaatttgtttcctgtcctataacctaagtttgtcactaggtatttttttaactgcatgtgaaagaaacacatgcaatagaaattaattttttattactataaagaatattcttttttttttatttttccataggtttttggggtacaggtggtgtttggttacatgagtaarttctttagtggtgatttgtgagattttggtgcacccatcacctgagcaatatacactgcaccctatttgtagtcttttatccctcgcccccctcccacccttcccccaagtccccaaagtccattgtatcattcttaggcctttgtgtcctcatagcttagctcccacatamcagtgagaacatgcgatgtttggttttccattcctgagttacttcactttgaataatagtctccagtttcttccaagtcactgggaatgccattaattccaggactattctttaaatcttatttcatatatttaaaaaaaatcacattattgatcatgtaactgaacatattattttaagtgycagttcataggcaaattatgagcagatttatatactgacctccctaatcctcgcatgatttgtagaagaaaacaagtgaagccccattctctaactattatacaatagttgggttactggtttcatacctttaggtgttattgtataagctctagtctctccgatgttgtttttagattgctaactcagctactatatgttggttattaatttttagaataaattatttggtgacccaattaaagaaatttgagatggggtggcragtagctaggatcaaaagttacaaatggattttgttttcatttagatgcygccgaatcctcaaatggctgtagcaacaacatgaatgcctgtcagcagatttgcctgcctrtaccaggaggattgttttcctgcgcctgtgccactggatttaaactcaatcctgataatcggtcctgctctccatataactctttcaytgttgtttcaatgctgtctgcaatcagaggctttagcttggaattgtcagatcattcagaaaccatggtgccrgtggcaggccaaggtatgccaactccaatataagtaagatttgacttcatctggcaccaggttgaaatccctggtgccatgaaaacatttcttcatgtgtggattcagtgcataatgaagctttcctttccctttaaatcaactggcacagcctaaagtgtttttcaaactttagtgtgtctcagaatcacctggagggctcacgccaacacagctccagacctcgtccccagatttttctgattttgtagtctagggtagggccagagaatctgcactcctaataagctcccagggcatgctgacggtgctggcccatggatcacgctaagaaccacaggcccagagcaatatagaatgtaggatgggtttgcaagaagtactacagagttggtgttccaaagaactgtgccctatttctgattattaatggagatttatggtagaaggtatactactatttaatatggtaatgaaatagtccacaaatatgatttattaatatatatttggtgaattgaagcaaaagagttcacagtgtcastccctctttagtaatcatatttttgcagcactttgtgcttacatactgtgaatgtatgaaacgatcacttgcttcctagatgagccaaggtttttaggtataccttagcacaagaggaactaagagttttctaacatcgctaggagaatgtcacaggctaaagagagaaatagagggtagaaaggaaggaaaaaaggatgaagtsaatgaaggggttgtagagatggtcagaaaatacagaaatgcacctggagaagggaatcagagagcttccagtcccacacgtcctcctgcctgatggtcatgttcacgtggacccatgactcatctttgtttttccatatctaaaaagttatggatctaagttatcatcttgtacagatatgacaaattcaatagtttttttctcccagcttttcattaaaaaaatgttcaaacacagaaacgttgaaagatttaggaaatatccttataccctttaccaagatttaacagttgttaacatttcttcacatttgagctctcaatttgtatgtgtgtgtgtgtacatgcatatgcattcacattcattttttatgaaccttttaaaaataaattttaataccatgccactttacccctacatatgttagcatacagtttcaaagggcattatgaaatattcataatcatatttctccagttggcctcacaatattttatatatagctgttttgttccatccaagatctaatcaagattcatgcactgcactgggaatatctcattagtttcttccagtttggagtagttgcctctagctttttgctatgacattgatgttttaaagaggcagacctgttgtctttgagaatcccacactgaggatttgtctgaatatttagtctgtctttcattttttaccctgcagttctcatgaaatggaagttaggtctaattgcttgattagatcaaggttaaatacatttakcaataatactttataggttatgctgtgttagttgatacagaatcttattaggaagaacataatgtcagcttgccctgctcttagtggcatttgagtttgatcacttggttaaggtggtcactgctacactgctgctttttaaagctgtattttttttccttcttaattttggtggaatctatgcaatcacacttaggccctgtgaatgtcttggctcccaagcaccttttacccattggttttggcagccatggatgatccttgtttgaaatgaytatttaatcgaggattgcaaaatggtgattttcttattttagcattccctttacatttgttagataatattcttctataaaggaaagctcttcgtgtctccccggtttactttttaaataatttattattattatgggctcaaatttttattttttaaattcagtgtgttacagtcaattactgtaatccttcttttgatgttttagtggatccattttggccagggagaacctcttcaagtggcgacctgtatatttctgtgtatgccttgtttcttggtacaataagatgtttcacactcacttcgtaccttccctgcctaaacctataatcaacatttctcccgggagccagagctccttattgtgggaaagagtagaaaccaagatgtgggtctgctcactgcaactgggaaaaaagggtttcattttgtaatggggagatgctcagagcagggggttgggaatgagggtttgagaggaagggcagacatttaaaagttctaatttcagtgacagcattttttaatgatcttttcttaacttccaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggtatgtaagctatatggtgattttaatatgtttgcatctctgtcatcttattttatgctagaaagtttagcctaactccatgtgctacaggtttgtttttctagacaattattaagaccatttaagatacattgaatctagattaagctacgtgtctatttgataaatgatacggtgtttcagtttacagatttataacaaattaatccttatcattttcttctgttattaacataatctggagacaaaagtggctaaaatattaaattatgtggatttgttttttttacacttagatttgcacctgatttctgcattagaaattttctaaattttcaagagaaagagatataaaaatataaactatggaacagcattcatttgctttgaagctgagcaattttagttgccaaattcttaattgcttccttttattcatatataaaaatcccttagatcatgagatattttattagtaatttttttaaatgcctggtccagtattatattaacttagttgtatttattcatgcacataagcttgaataacccctcatttttatcactcatctgagtaaaaataccactcataattagtggtattatatgttttggaatataatccaattctacataaaatcagtatcattgaatcaagcttggtgagtaggcatcacttagaaatattagcatgtaggcagggcrcrgtggctcatgcctgtaatcccagcactttaggaggctgaggcaggcggatcacctgaggtcaagagttygagaccagcctgaccaacatggtgaaaccccatctctactaaaaacacaaaarttaaccaggcatggtggcgtacgcctgtaatcccagctactcaggagcctgaggcaggagaatctcttgaagccgggaggtggaggttgcagtgggccgagattaagccactgccatcaagcctgggtgacagactgagactctgtctcgaattaaaaaaaaatttaaaaaaaggaaatataagcatgtattatgaaaatctaagtactataataagagtttattgcaaaaagtaaatatggaagtatggttaaataaagctttaattgggttcctaactcccgttcctgaatagaaattactatttctgagggtatagataaagcagtagtcagcaaactatggcccgtgcgtcaaatgcagcctgttgcctgtttttgtaaataaagttttattgtaacacagctatgcccatttatttgtgtattgtctatggctgctttcatgttacagtggcagtgttgagtacttgtgaaaccatatgctctgcaaagcctaaaatatttattatgtggccctttacagaaaaagtttgccaaccctggattawaggattggaaatgagcaaatgcatacatagcaagtagagttaggtaatgaaaaaatgtatcagtaacatatttcacattggcctsatttctctagaggtggtttgaatcagatataggaacaaaatatgtgtgtcttggtagtagcattgatagttcaacaacagactttcaactacatgaaatcaataatttgtggtcattctctacttattatactatcttcataaagttatctttttattctagcatgtacataaggcccaaagggaaatggacttttggtcacttttagaaggtccatgggatgaaaacacctacattagttagaaagactaaggaaaaacttcatgttaaccttaagttcaaagaccatttgataacattaataacaacctgagatgctgctggtgctccctctttgctacttttatcacattgggatggaagttgtgctatgaaaatgtatatttagagtgtttcaagtaggtattaagcatttagagcttcagatagaaaaggagggacattctggaaaatatacctttcagtagaaagtgggttatgatgttgctatgaattctaatctactttagaagctgaagataggcactttctctctaaatttgaagacacaatctctataattcctaggagtaagaacttatttttctaagcctagactgggacactatcatcttggaaaagacaacatatagtgacccagacttcaaccttatatattttgttctgaatttgtaaagttctccctttttttcttcttggttctccattgatcagcrtgcactttcatttttcccataggaamtctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgaytctttagatataattgcaaggattcgtatcaatggagagaactctgaagtrattcgttatggcagtcgttacccaactccttatggcatcrctgtttttgaaaattctatcatatgggtagataggaatttgaaaaagatcttccaagccagcaaggaaccagagaacacagagccacccacagtgataagagayaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggraagaactgtcatgtctctagactatgacagtgtaagtgatagaatctacttcacacaaaatttagcctctggagttggacagatttcctatgccaccctgtcttcagggatccatactccaactgtcattgcttcaggtaagtgcactccaggtgctgcttgtcctgcaagtagacacaatggggtcaacacacatggatgactgagtgtttctaatgcatatgagactctaatgtctttgtgtgtrcttgtgtgtgtktytgcctgtatgtgtccaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtatgccatcatcttccttgttatatttctgtctgcttatttctggaaaaaatggggcctgaaattatgttcatagatagccaatgtgttatgggcttataaaactatggctacagattcaaaaatgaaagcatattgagtgattttacgtgggaaggagggtgcagcgcatagctccctttgatggcagaaaggttggcaacatactaggaagtcaacaccctgacttactagatctcctttggacaagttgtgtaagtagaaatgaagtttcttttgccatgttactggcaatttgcaattaaagaatattgtccttttttttttttttaaaggactatgaggttccctgtgaattaattattgactccttttgtatgactaggtacctgtactgggctgactgggatacacatgccaaaatcgagagagccacattgggaggaaacttccgsgtacccattgtgaacagcagtctggtcatgcccagtgggctgactctggactatgaagaggaccttctctactgggtggatgctagtctgtaggtgtctctggttactcatgtgggtgttaagaagaggtttttcttccatttccaaagaagagggatttgcatcatgtgatgaaaatatagcatgccagatagacattgccagaatatagaatcacagttttaggaactatgtttatattggaacttggtgwacatactgtgaaaatttatctatatcatgcattgaataattatgaactaaaagacatctaaagatgcattgctaaatatatctataatttcagctataattataaatgtattttctcaatttagaattacaaatgaaattactcaacttacattctgcaggccctaggtaactgctataaaatctgaatgacttttaaatgccaattgatattatgtttttttctgggctttagcattcaatgtcttttagaaaattcttttcttaaaaaaaaaaaaagaaaattcttttcttcagtctttgactttttgtcatcttttcaaatagaccctttcttctctggcaagcttctcctcagcgcatttcttaatattttccttttgtcaactctaattttgtatgtaacttctccaagtaccccccatatgtctcacattccagtcatcctaatggaatagttgaagggatgaaatgattttgtttattatggctggtgtctacatatcgggaatcttaatttttcttgcatatttctttggaattttagtcttttgatgccaagacctaacctcctgatcttttctttattctcctatttgaaacaaagcagtgatgctttgagtctaagcttggattattctaggtaaacacctcaaggtactcaataaacatcaaattgaaaaagtcactaaggaagtgggatggaaaagttattgttttattgagagtctgctatgtgcttaacactgagttccatgcattacatggattatttcatgttttcctgtttctaatatcaacctgattccttttgtaggattactattcatatttggaagtcaatgattttatataggctattgtttgataagcaaacaagacctcccatcaccagaagaaacatttccagctgccatatgccccatttgaaaagaaagtttgcagcttgtgtaaacaatgatgaggcgcatgcattgggctgccagttgaaaacttaactcacttgagatttcaacttctaaatttttttttgcttcattttaggcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaratttgctctcccagcccaggggartcaacactgttgtgaagaaccagaaacaacagtgtaacaatccttgtgaacagtttaatgggggctgcagccatatctgtgcaccaggtaaggcactgaccatgaaaattagaacatggagaataatgatcacaataccaattggtaaggaaagctgaagttctcacaggagaaaaaattcaaattctccttgatgtcagggtaatttatgaaacagacctggggctatattttgagaggaagacttggcaggcttcttttctaatctatatggagcccttttatgaaagcattttcttttattttatttttgagacggagtctcactctgtcgcccaggctggagtgcagtggcgggatctcagctcactgcaacctccacctcctgggttcatgccattctcctgcttcagcctccctagtagctgggactacaggcacacgacgtgtccagctaatttttgtatttttagtagagacggggcttcaccatgttggccaggctagtttcaaactcttggcctcaagagattgcccacctcggcctcccaaaatgctgggattacaggcgtgagccacagcactcagcctatgaaggcattttaaatacaagcttgatggagttagaaagaaagatgaaggccttggctgccctacttcatgtcttgactaagaattctgtcaatgagctggccttccttataaaaggatttacattttctgcttaagaggtattatttatagtttgaaatatttctggtgatatttgcgggtgggatcatatgtgcttcattgtgcattttataaagaacaacaaattcacgggaagatgtgccttttgatgttgttgctttgcaaattttgctgagaagagtcgttgatatttcctgttgtttagaaggaatcggcacatttattagaaattggtgattgctcttcttgatggaaaagtgactcagaatatagttaaaaggttaatgggcagaacttccatggcgcttcttagggagcatttaatgtagaagctgttgcaagtgctatygtggaggggtcaatgtgaacsgtggctgcatccatcttttacttcttctgggattatctttcttcaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtggtgagttggactcttggcgcttttggtaggagctaatggcatcttgatgtcaagtgtttggtatggaatcctgctrtgtgtgaatgtgtttgaaatgtgtgcctaggcatcctggtagagctgaaaaatgtttcctctgataatccagactgtttctgttaaatcacctctgtagtggttaagagcacaagcacaatcatcatcctggtgatcgcatttgtaatctgtatagacctgggaaagttacttaatatctcaagcctcagacatctcatctgtaaaatggagctactactagggttcttgygaggagtaagagaaacaatatgtaaaaatcccttagcatgaggcatggtgcaagctaagtctagcttagcttgggactaaggaaacgtatcattttaccaattttcrtagcacaaaggtcattatttmaaaaattttatgaaaataacttccaatcctcagcttccatctgaatagagtgaataaaacacagtggactttctcagggagttctgaggttggttaccttttcctagcagactgtgataggggctaggagtttttattttcctgaaataaactataattgcatgctttttgtgattgagataaattgagattatagagaaacagaatgactttgattkgkgcttaaattacttgatttgtgcctaaaacaattttaaaaatgtatacaacatattttgcttaatctaactaattaaaagtgttatctcactttgcatgcagtccattttgcagcgttttttgccttggaaggtaaattcaaagtgtctcttttatttaattrtatctttttaaaaattaggataatgttttaatcaagagggtttgttctcatgtttttcctgttcttagcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccgtaagtttatcttaagtgcttattgtgattttgggtctgaagtcttggatcacaggagatgaaattattatataaaaaaaaggctttccaaaaatraaaaccctaagtatttatctaaaacgtaaatttttggctaggcgcggtagcaagtatcaacaaataccaatcttgtttcatttttctctccttttttctagtattttaaagtgactcctagtcmtgcacttcactgataacattttggaaaataactaccatgccattataaygcctggcaaaatcaaaagtgcttactaaatatcyctgagtacctagtccatgttcaaattttgtcacttatccccaaaatgtatttttactgttctctgttcaagttagggttcagatgagatctacaactgattttgattgttatmattcttcaatctcttttatgccacaacacttcccactttttaatgtcattgattcattagaaagattaggtgatttgtcctgtagaatatctcacattctggacttgactaattgcataattgatccatttaatttatcttatccctcttatttcctatgaactggtatgtagacctagagttttgatcataacaggtgcaattctttgggtaagagtatttcagaggtggagctgtgcctttcctgttgcatcaccttatgaggcacatgatgttttgttgccccactttaagtggattctggtgtcagcctgaatcatctcttatgaagctcccatcatcctttcacccagtggttttagcatccatcggtggttgttccgtaaacccattatttctttaagagttatgaatgggctctttagaattctagtgttcctgccgcatttattagctgaagtttgataaagaagacatttcccttaccagcttttgttggtaattagaatctacaggataaataccttttgcttgtcaattttcagagtaatgagttggtgacaaaggagaattaactttttgtttagtttagtttagtttagtattatattgaactctttgatcttcatgtatttgatgagttttaatacagtgctgtcaactgttttttcttggtgcccagttgtccaaacttaggccaatgggagtccttaacttgaattttctgttctttggcatgaccccaatccatcttcttatagctcaagcttgtcttatatttcctgtcccagtcctggaattagccacttatccaaggagacctcattccctttgtggtacttagaaattatcacagggttgagttgctcattcctacttagctttcattgcttctagtccttttcaatggtcagagctaggaaatacagtttttaaggaaaaaaaatttttttatttttttgagatggagtcttgctctatcgcccaggctggagtgcagtgacgcgatctcagctcactgcaagctctgcctcccgggttcacgccattctcctgcctcagcctcccgggtagctgggactacaggcacccgccaccatgcctggctaattttttgtattttttagtagagacgaggtttcaccatgttagccaggatggtctcgatctcctgacctcatgatccgcccaccttggcctcccaaagtgctgggattacaggcgtgagccactgcacccggccagaaaaaatttttattgatatttcccattgaaatttaagattacaggttgtttacattttagattttataatgacatctcttcttatgcttaaaatcatagtttctcttgacatttagttgttttattatatagtaatttcaaaatgcctataataatttcaacattattataaccactcaaagaatactattaacaataagtctactaagtgcgagattcttcttgctttttagattatgtcccactagagatatgcagtcaaaggtatgactttaaagatatttggaatttttttttctgcagggttatgctatcaacctgatatatagttagctttatctattgctgtttccaaattttattttattttattgattttatttgtacaaaatagcatacatagttccaaagttaaaactacatgacgaggtgcatttatagaagtccttcatttcttcctctcctttctgcttcctctgtgctcttctcagtctatccagagagatgacaatttttgttagtttatcttttctttgttgttattgtttttaatataagcatctctctcttgctacacacacacacatacacttatatcgtcctttttcttacacaaaagttagcctactgttttgaatcttgctttcttactattaacaatatatcctgaagattatactgtcattacttatcagtatatagaaatcttctttattcctttaatagctacatattactccattgtgtggaaatgccatagtttattttaccaagagttggaactcttgttgatgctattaattaatgaaaacagatgatttaagttacaaaccagtgtctcctctcccttctccccagtatcagctggaaatatgtttttttactacagaatctataggtaacataagtatcatggatcctgcctttctgatggctttgaaaatgccgcccttccagtggtttgagttccacaatagatgtgttagcacggatactgttcataatacatatttggtggatatattcctaatatttatctggttgyctttttcaagctgatcgcacttgccagtctggatacacaaaatgtcataattcaaatatttgtattcctcgcgtttatttgtgtgacggagacaatgactgtggagataacagtgatgaaaaccctacttattgcagtgagtaagataaaactgctttctttctatcrttccagagrtgcatgttgtgagctaatacaaagatatgaagcgtgggtattcgggctgatttcaattgtcatttcacattgaccttctaagtagaggtggtaggcagttgctttcatatgtgattgcaggggtatgagaaactctttctctctgttccctggctagaattcccagaccctgaatatttcttccagagatctgctactattggagagccatttctcccagtgttgaaagccttttgccttcatgtacttaggcagaatttgcccgttaagcccttataatttactcttaatattattatagtggccatcagtaactgaaaattatttttttttcagacagtctcactctgtcacctgggctgtagtgtagtggtgtgatcacagctcaccgcagcctctgcctcctgtgctcaagccatcctcccatctcagcctcctgagtagctgggattacgtgcatgtgacaccatgcccagctaatttttgtattttttgtagatatggggtttctctgtgttacccaggctggtctggaactcttgggctcaagcgatccacccatctcagcctcccaaagtgctgggattacaagtatgagccaccgtgcctgaccagtaactgaaagtatctttatatcccctagatacgttggaatttcagaaatctctatttcgtatttagcaatttggttcattcaaacaatttcctgtatttatagctcaaattaaaaggcctttcttaagtttgataactttgagactattagtgtaaatagatacataatttaaggatttagtgattggacttccctgttctgtgtatatgtagttaaactcttgtcactggcccctcccaaggaaatcaaagggcatcataattatttgtcaccaaattagggtacagcacaggaagaggaatctgttgtaataacagcagcacaaggaagcagaattcaggttgcagccaccagatagggctagacagataggaattattgctgacttttcagggacctctgcttccattgtcagttctcccctggcaaatcatcagatatcaggggccaaagcaaaacggccttatagaccagaagaattacaagactttaattagatgtgcacccacataacaatttggaaaatgcatataaccagagctacctaaaattactsgagaaaagagtcaatgttcaaacataggcagagtttcccacttactcaactaaaagtctggtattccaaggatgaatacgaagataactttgccaactttctagagttattatctaacatagctaaaaggttgtgtgtggagcgagcttagatatgatcacattattgttttgcttttaattatcattgcaatggaatttatttaatcttacattatagtagaaaaaataaaaccaagacttataatttgtgatttcatttatcacaaagatagttctttggtatttctaacaaatacaattttttttttttgatttctggaatctagaaaaacaaattggggaattggggcaggattgacttccttctgtctcccatacttcttcctccccacagaaagcttacacaagcatccattttccaggctcagtcttccttttttggtaactattatctagctcagagatagaggcagattgttaagactgatgggaacatgcttrtgttttgctcatgggttttatcttctttccctcctgcagccactcacacgtgcagcagcagtgagttccaatgcncatctgggcgctgtattcctcaacattggtattgtgatcaagaaacagattgttttgatgcctctgatgaacctgcctcttgtggtaagagagtaagcaagcatgaaaaacatcacgatgcagctagacaacttcagtctcttccaactgcttcaaatacagaccagggtcatggctgctgaatgcttggacttcctgtcccagctttcatctggaatgctgacaccgctcagcggatattcattaagacctgttagtggagagcactgtgtggggagctgatcaggatacggaagctgctgattgatgctgataaaatgaaattatattggtgatgcacctaatacagtgcttagctggtagaacttaattttagttggctctcaattgaagtttctgaatttggttgagtgctggcccagaaagctgtcagaggacctaaaagtgattggagtcatatacatggggaaggagtatattaggagcatgcatcctcttcctgttctctctctgtgccagtttatgagcacaagaggcccaagaagttgcaggagcctttggttgtattcctggggacagttatgccctgtttacatttggaggctgctatttgccttcacaaattctartctatatccatgcacattttttacataattgtaaaaatataaaaatacaatcttctacattgctttaaaaaacctgtcaataaatcatattgctatataggagtcagaaaactatggctgtggccagttgcctgtctttatagatagcattttactcaaatgcagccacatatggctgctgtccctctactatggccacgtcctgtaggtgcaacagagaccatagggcctgtaagcctaaaatatttactatctagttaaaaagtttgctcgtccttgtcttcatactgccttttaatgactataatattccattgagtggttatagtatcatcaaattaactgcctctattattaagcattaggttgcttttattttattcctctatagtatatatcattgcagtaaatattaacatcgtatttaaaacattttattttcaggatattttcttaggatcattagtatagttttatagctgaagtcaaactattttcaattccagttttctctcaggtttaaattctgtgttgaagagtggtatttggagtgcttcactaagttctttttccccaacactgaaagttttatagaaagcaaagggcacatagagttttgaggacctgtaaaggaaataactaataactgctggatgagtagaatagtcttagagattgtttcaaatgtatgaattattggttcaaatatatgaataattaatatgagtttttaaacttctctatggtaacaaaagccatagtaatagcagtgagtaccaatgacctgatatatttaaataaaaataagcacataatmtatatatgaatatatcctcattgtagtaaagtaataatattcagaaatatattttaaagaaataatacgatgtacaaaaaagtaaaatttacattttttcatccttctccaatcccctcactcctcaaaggtaatcactattaaaaggttgagtgtgaatttgacttacttttatcttttatatatcttactttacttttatatatcttgatatatagattttaaaaaaacagatggagtcttactatacatattttctgcaattagcttttattttttaagcttaacatcatgtcagcaaatacagaccagcctcattcctgtacactgccaaagaatattttaaaatgcgaatggtccatgtatttttatccttttcctagtggttggacatttaggttgtttccattttttcactatgaaaaacagtgtcagggtgaacatcctttgtgcacatgtggaaagatccttatggtctagatgtccagaaatggtgctgctgtatcaaaggagatatgtctcttcaaaaaatctggatcaggccaggcgcggtggctcacgcctgtaatcctagcgctttgggaggccaaggcaggcggatcacaaggtcaagagatcgagaccatcctggccaacatggtgaaacctgtctctactaaaaacacaagaattagccgggcgcggtggcacacgcctgtaatcccagytactcaggcaggagaatcacttgaacctgggaggcggaggttgcagtgagccgagatcgcaccactgcactccagcctggccacagagtgagactctgtctccaaaaaaaaaaaaaaaaaaaaaagtctggatcaatgtacacacttttcatagcagcttctgaaagagcctgtttcttgttacygttatgatataggctgtgtctttatcagttgcaactatactttctcttgccttaggctaattccagggtcccctgggtttgggagcctatgacaccttcattagttaaataggaacatgtggggttagggttagagcatctgaatcagtgatggctaatttgaagtagaagagtgacttattttaattcagtatttattgaacagtggtgttctaggaacttttgggctgtgtcagtgaataagacaacaatccctacccacatgragctaatattctaaagaggggagacaggcaaccaatcagtaaattgtctagtatgttgaaaggtggtgctaagtgttatggaaagaaggaaagggagcaaggaagcgggcatggggagtgcaggcgrggggagactttgcacaaaacaaaatggttttggatgaaaagtagattttaaaatagaaacatgtgaaatagtaggtaattcatatctttcctgggaaaagaagtgttctttctctaccatacacataagggaatattgtatctcattttagtcaccaaagataattagggctttgcactgtcagttgactacttttacctcaaactgttggtcgctggtactagtcttattggaggactaccctagatgtatataattaaataatgctctgtttcaggttttctagacaacccatgctacarccagcttgtctccagattcctggactgtaaaccactttttttcactgagaatgctattgatcttttcaggtcactctgagcgaacatgcctagctgatgagttcaagtgtgatggtgggaggtgcatcccaagcgaatggatctgtgacggtgataatgactgtggggatatgagtgacgaggataaaaggcaccagtgtcgtaagtgaagccaattaattcctctgcagagtcacattccagggaaacacagtagagttgtttttctgtgtttggagagtatgattgcagatttctctgtaattgaatggacactgatagaatgttacctttgtttctccatgctgggagtgtttgatatcatccacttaaatgcttcagagtgatgaaaaatgactttatgtttactttctttctcttacatttggctaatggacataatgtcctacatttctaggggaaaaaaaaaacccacaaatacttggttgtctccttttcttttttcttttctttctttctttttttttttttttgacaaggtcttactctgttgcccaggctggagtgcagtggcggtatcatggctcagtgcagcctccaccttccaggctcaagcgatcctcccacttcagcctcccaagtagttgggaccatacgcccaccaccatgcctggctgattttttatacttttttttttgtagagacgaagtctcactatattggctaggctaatctcaaactactgggctcaagcagtcctcttgccttggcctcccaaagtgctgggattacaagcatgagccactgcacccagtggttggccactcttaatagcaaccttcacagtataacaatgaactgtctctrgtttcctttgtcaccttaaagcggcatggagggaggggtgttatgcctcttgagtagataatggaacatcattttcattaccaacagggtatggaaatcttagctagttcaagaattaatctaatcggtgttagaataatgtctttctatggtagggcaatagactcaatggctccctgctgcttgcatctgatggcaccctcctgtgttgtgactttggtggtgggtcacaactccacatttaccctatccaccctatccactgacatgggtggttttcarctacacatacatggattgtggtgtatgcatttctctcacctgtctttaccaacatcwtcttctttcttttgtttcctattcacctgcaatgagtctggataaaacccctgttcttttattttgtggacactaatgatttgatgtcagcatctcacctctttcctcatagcatcatggtttctgacaactctgttagcatatgcctttcctctccaccccaatattgcttggggtggtagctataatgtagttggaaaagcactaaatttggaggagaaagacctaggtttgaagccccagctcttcacctagttctatgactttgagacatccagttaaccatctttgagcttcagttttctcatctatacaaatggtgtaaaaatacctatytcacattgtgcttgtgtgattatactttgtaaactaaaaaaagktaccaaaatataaggcattcggtatccagttaacaaaatggtagtggttttctgaagccctaagggaaaaagtatgaccattctaatgtattttatggaaaaataaatgagacattttattgtattgatttctttgaaaaagccagggtccaaagcaattaaaatggaatctttggaggtatttttattatgatctattattataatagcagtgtaatttgtctacgtgttttcctcccatttcctttcatacttagaatggtaagtaacattaaagcaaagagaattaactgctgcactgagctctcatgctttctgattcttgcgtgctttggtttcagagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcakgtgaattgaggattcagaagttacccagcatgcctcaaatgtccatgggggctgggctcacttacctatcaggcaccccgtggccacagtgcccagggcccatgatgcttttagtggcttatgaaaatgtttggattcctttccaaatcaaagggaaaaaaaacttttacatcaaagaaagtattttaatatataatattaatatatctggctttataccaatatgattgcattaaaatgaaaagaagttacttgaattattaatacataataccatattaacaatttaaaattaaatataatttttaatatttttatggaggaaggaacccaagaaggcaaaaatgcctagggcctgtgaaagacagaatctggccttgcacagagggccagggagatgaatggatagggcttgagataagaattctttcttgaagctggtgaccygcttagttttccacttggagtagaggcattggtattacaagaactgtttcactctcytctctctactayaagaaaaataacagcacaagcatgatgataaatagagcttggctcttaggctcagagtcaagtagaggcaggtggagtgaactgagacaatgtctccaactaaggatgcagacattgatcaatatcatgcagaagggctggaaggccagactttctgatgctctctttttgacagaagttggaaatctggattttcatttgaaatactctgattttaaatgctggaaacaaattttaaaattcttaaaacactgtgtggatcaaacagattcggctcacagcctgctggtttgggggacctctcctgcaatgttccattgtttgacttcttacctctttctccaaatgggcctcttcaaacagtttatatacattcttaacatcccaacttctcatcatcccacttaacaaatacttggattatggaaggaaatggagaagaacaatttgtaagtttcaatcctgattgactaggaaaatagtacgagcattagcaaaagtaggggagtccagaaaggcgcttgctcaaggtggaaggtgagtttgacatagtaggacttcctgaggtgaaagtatgtcttaggtatttgggcacaactggagccrtgaagagatattgcttgtgccaaggactgttaagggacacacacaggcacattgagagcatcaggaatggccaccttacagcatgcgaaggaagacagtgggaaagatatactaagtaggcacaagatcagagaagcagagtcacaggggccattgactggaggggcaggcagctcatcaacaggcgctaatgtaccrttggagtccagtgtggtgtacgattgtgtgtttattgtggtggtcctgaggaagaaggaggaggtgaaggagcagggactcagcagtaatttaaaaagtagataaatgctatcaggaaaatacactctgtgggtgattcatcctctgatgagtggacattgctgagaggtgrtagtttgtgaactgacaatgcaaagacattcaagaggtggagctgtcttcttttgtagtgaagctgcagtagaatatgctttgtttgtatttaagtaatatgaatgtaaagtgtagatttttattttttgcacctaaagtggataaatctttgtctatattttctccctactgctcaagagttctattgtgttgcacttctatagtttttctgaatttggtaaatagctaatagcattagtcttagatgtaaatatattctgaatacctaggcttagactctaggcacaagaatggtagcaggtgttgattttgatcagactccaagttatctcctttattcctcccattctgagctttctgggttcttcctttatcattactatgatctcacagcacagtaacatttcctctctccctttctttgttcgtccattgttccttccttcactttccctccctttctctctctctttctttttttccttgagctttctgaatttccttgaaaagggctatagtagaagagaaaaaaaaaatactgtttgtttgaaaacctgagctatcagcttctaagtaagtccaaaatctgtgtctggagtagcctctactaggtgtgctgttagtgtgcatctccttgcttgcttggcagaaagtgtgctccccatttggtacagtgggacaggagatcatttttcctattgaccttctttttttcttggctcactactgatgctgctgaaaaacatggatgataagactgaggggtgacaatttggtgatgagctggaatactgacttgcaatagtgtctgaaagcttggtgatttgcttgatgacttgtttttcctcctgcattggatctaaattagacaaaggaaaacattggtgttttcaaaccatttggaaatgagttaaatagctcccgggagaccaaatgragctgagccagtctgccttgaccacagctttcttcacaattacatgcacacattttgctgtaaatcatgttgacaaggccctgggtttatggatggcagtgctggttagcaggcctggttataggtcrgttgtaaaactgaccacattcaccgttgttgccttcacattttgtaatgctctatgtgccgctcctatgctttctatgataaattgttcaaaaccattagctttgttcactcttatcaaagattccttgatgcatatgtgagaccccctttagacatcataacttttatgggatcttggagtaatatggagaagaaaggccagtttggctcacagaacttcaggaaattatattgttataatgatgcctgtgtatgttaggtcccgagatagcttctagtactacagcatgccttcttcctttgccagtatgccatgctaacctactagcttgcctttattcacatcaccatgaagactcacatctcatgatagatggcaggagtgtaatgaaagatggaaggaacaggactgacaatgtaaacgttattccagtgggaagatatgtgttcttagaggacacacccaataatcttatttataatatatagcactcaccctatgagtttccatttgggtatgggcacttttatcatgtgattacccagtacattgccagtgcctactggctatctcattatctrttgaacatagatagtgccactgttcataagctgtctcatagatctgatgtataccaaaattacaaaagttgtatttaattagtttatcaactaaggaaaaaatgaatgcaattatttttaatagctatagacctactaattatctatagctattaaatggtagcatttaatggtagcatttctaatggtagcagccagcccctgaggaagttgtgtggaatgccaaatattggattcttctagaattggcgattagtggggtagacgaagatgatgggggaaaggggatcaaggacactggtgatcttgtcgaaatggttgacctggcatttaggtagataaagaaggaagcaaaaccccaagtgggtaatagttgaggtttattgccaacctctctgaaagtggtactggatctcatgatacaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgyaaccacctagatgactgtttggacaacagcgatgagaaaggctgtggtgagtacaacagaggatttgggaaaaggaaacaggggagactgaatatggattctcaacccttcacgacttagactttccaacctgtcctctaactacaaagttaccataaaatcactattcctgatatagcaaaaggttaccaaagtttcttggtatataagatggggacacacatttttttggaccaattctttgcttagatagtcattagagagaacagaagatgggcaaatattcaggccatcatttaacattattgccaaataaggtactcaagaatgaagggaaccaggttgattctctttgaattcttgtaatgactttttgcctgaagcatccctctgctagaactcgttggcctgttcttcatttttgtcctcaggtaattgaatgggagagtttaatatctctctcaccccaaccaccacaagtaaagcagttgagaatccacagcatgggcattgtttgcttagcaccatcttgaactccataatattggcagttcgtcctgtttgtggtgtttaatccttgtaaccattgtttcatgtatgttgatattgtctctgtaataacaatttagagaccatatcctttcatttattttgttttctttattccacttgttcattgtcagtactcattgaaagcatttgcctaattgacccagaagtatgtaatgtagtttttatccttatatgaaagataagatttatatgaaataacattaaaattaaatgctagacagaaactgctgtggaaatgtggagaagagattatctatgcataatattaaaaaatctgtgcagcaaaccaccatggcacgtgtttacctattataacaaacttgcacatcccgcacatgtacccctgaacttaaaagttgaagaaaaaaaaagaaaaaaatttaaaaatcatccaaaaactggcttttgctctattgtaagaaaaacttctataaatttctaccaaagtttcaaaaaccatttaataaattaagaaaaacatgtgctatattatacatttatacaaaaatcatagggaactttcttatgtttactcctaattcatatagattcccattgcattttaattaattttgccttacctcaactataagaattaaatcctcaatagtacataattcaaattaaaatttttagcttgaagacgaagtgatctcagtaggtctcatccaaacctatgaaacattcactcttacaactggaaggagtactagtgatcttctgtaccctgttctctttgcagataataagactgtagcccatagatgggaaacgaattgtttgggggtgcacagtgaactagtggaagagcttggcctgatatttggataatggattttgcaatgcatgaagttttaatctattgctccttgatgagtagagaactaataagaacttgctgtcctccctctgtagatcatttttgggtgaggttgcccatgtgttacaggaccagccagagggacatgtagtgttgtgttgcacctagtgttgagctcatgccatctcgtgagaggcaaatgtgtgtatctctttgtggttccrtgttcagtgatgtcacactggaagcctgagcttgaccatggtgtgaacagtcacactggaacatgctacaaatcagagcatttagaaaatttttcctgagtcctgtttgaccagcacactggccaggctcttttcttctcctcttctttctcatttctcctgtattagttgttgaaaccactgatgaaggagtaagttggtgaggaagttgaaaaatagtgacttttcaataatccacagtctttggaagtctttgttgtctgtcttagcmtgattcattaagaattggcactgtttagtagaaatgttgactttgaaccattatagtgagttggtcgttgatattttaggatctctaagaactgctttttacctacaggcattaatgaatgccatgacccttcaatcagtggctgcgatcacaactgcacagacaccttaaccagtttctattgttcctgtcrtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcraccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccaggtaagaaaacactgatgagctttttaaaagttaaaaattaaaaaattctaaccatgttttcatcttgataggaaattaatttttcaacttgggttaatatgcagatacatttaatgtttctgcaggtttattttctgctttgtatctgatattcaaatgatagattcagaacagaatatctaattattttaaaaatttatagtatcatttttatggaaagaggaattgcaagggaagagagttcactgttgctggccattcacttaactggagatgatatgaagggacgattcatgcattcattggtgcattcagtcrttacttcctgagtccctcctacatgcccagcgtgatgacaagcagcaggggttttgaggggaacaaggcagacatggcccttgctctcctgaagtacatagscttgcttacaatacttgtcattggccgggggcagtggctcacgcctgtaatctcagaactttgggaggctgaggtgagaggatcgcttgagcccagaagttcaagaccagcctgggcaacatggcgaaatctgtctctaaggaaaatgaaaaaaattagccaggaaaggtggtgttcgtctgtagtcccagctactcaygaggytgaggtaggaggatcccttaagcccaggagatgcaggttgcagggacygagaacatgcatggcactccagcctgagtaacagagtgagaycctttctcaaaaaaaacaaaacaaacaaaacaaaaaaaacaaccaatactagtcattcccagcatgggctgggcgtgaaaactggagaatggctaacatgagactcttgttttgagattgcccttatggaaactgacagtctttaaggcaggccagtgatattttaactaaactaccagatgaaccacacttcttaacatctctattgaatatcaaatctatcggattcttggcagcataaactaattggctttgtggtcaatagacatcaatctgcaggcactgtaaagatgtatgctgtaaagattcttgttgcagtcagcccagacctccagagggctcttccccacatccttatatttgactcccttaagggtaaagatcctaaaatgggtggggacagttggcttcccagttctccctgaccagtagctggcctgacataggtgctgagtgcttgctggataataaatgaaacrttgactaagcattcctattgtatgtatcaattcctgttttacgtatcctacatgtcaaaaagtatagtgattaatgatttccaggaacagaactgagcatggtactgttcttgtcaccatcctttgttccactgcagaaaaaataatatttgaactgtaagacattgtcattcagccctctctctcagaaactgctagaatgacgtttctcttggatttcagctatttcctctctatctcggtgtgttctttatcagaagagaattaaatacatgtgaggaagatgggcaagaaagtctgggtgagggtagggtaaacttttcttgaaagtccaggagggtgcacaaccaggctcagtgttcctgaaaacacaaaggcagaatggagcccagttacatttacattggtagggggcagttctaagatactagctacactgaaattagaaacaacttttttctccaatattaataaatatttctgctgtcagcaytagggtgtttggtttccaaagcccttgcatttgatatarctttttaaaccaccattacgcacattggaagatactgttggctctcagttatcttaatttttccagtagtggagacggaatatcttctccatgttttcttgagaagaatctgttcacaggatgtcttttgactgtggaataaagagaaattaatgggaaagcagtaagctcaacagagtagagtgccctatggggtagccagtctgccaggacttgaatggtaatagcaacaggaatactaatacgacaagaataataatagcaactccttctaagcctgttgtgatctgaaataatataatgttttaaaaagtccctggtctgaggcctggcatttaacaagtgttcaataattagctactattattctcactgttcttagtgtctaccatgatggaatccaagattgtagccatctcattcatcaggatttactcatttacccaagtgaattaactggcaagacttgtacatatatggatactcattctttcttgctgaagcctgaagcgatgctactrtcctaactattcagatatccagcatgaatggttaagcgcgtacttgttgcaaagaggcattcaggtcttttggaagggaaatcattctccttcattctccttccggttggaattgattatcaaatcctaaatgaccttctcactataggtgcatttaaccctttggaaggttrtggatgctataagactctggtgaaagccctgggcccctttagaaagtacacagatcaccaaagctggcttccctgattctgggtaaagaccttgggttaagaacacttaccttataagaaaaataaattttattgaataaaaatacatttataacagaaatgtccttgaggtagcagtttctaacagatcctaatatgtttctaaagcttcttaggtttgattaagtgaaatgtgtctcaggttgagaaactcattttgacagcctgtctgacagaggcagggatgtctctttatcctaaggatgtcataatctttatcttaagaatgtcataattcagagtttctctgtgcagtttcaatgacacacttagacaagtgtgtttccttgactccaccatttaaactgtaattcatgatactcacctctgcttccctgttctgctaagcctttgcactgcctggagagggtgccttatgctgcatgaggaaagtaaaaccagacccgtcgaatgaagtgtgtcccccgtattttctacatgacaccaycttaaagtgggmattattgcacacagtcttgcaccctctgttgcctcactgcaggaagacaaacttcctgttttcccctgccctcatttgcctgaagaaaggtgacttctaacaactgtctgtgattctcaggtagcttgggtaggaaactgggtggctaaatatgtaccatttcacaaagtgactgtattggttaactcctggctctccattttagaaagctctactggttggatgcccgcctggatggcctctttgtctctgacctcaatggtggacaccgccrcatgctggcccagcactgtgtggatgccaacaacaccttctgctttgataatcccagaggacttgcccttcaccctcaatatgggtattgtctccctgcaatcctgggcttttctttcacctccttcttctgcctctgttamcgagaaggctgttcatgtaactatctcaaggccaatgtcttgctggggtttgtcttctgcttttcctacttggtaaattgtttagtgtaatgagtagaagcatggcttcttcaaatcatcatcatcagctcttctgttttcttttccctgacacacttttgcacttttcaagtcctgtattttggctgcatgcaaagaaaactgtggtttcagaaaaccgatttctttactggactctcgaagtcaaagccactgaaatccagttaactatgtttatttgtgagcattttctgtacattgtccccttcctttttctttttwagattatttgctgttagctctctttcttttctgaatgcagaaaagaattcagaatgcagtctgctctacagaatgcagactccatttctctaaatggagaaaaggtgtgtattttggctactgacttcttttggcatcagggactgaccctttgtgtttgccctgacaggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtacgtacatagaaaagcataaaacaattgtgtaactgtttatttcaaacatcagagcttgtgattccagtctattagtcccctctattgtctaactggcctgtctgttggaagtcattcgggggaagtcacacttctaactaaaactgctgagctctatggtatggtgcagtagaaagagggtgaacttttaaatcatatggatcagggtttatgacctgatgttttcacttcttattgtttttttatctagaaaatggggctaataatctctccccatggtagtcagctcagtgtgcaactcatcttaattttttttatctctttaatttgctctcccctatgaaatatatgattaataaattttagtatttgagaaaaggaaaagaataaaaggatctggaaaactttccctaaaatactttggcacatttatggttaagtgcagtgcagtgttttaggtggcagtagagtctgttaacattaatccaatatgataaggcatttacatctttctggtaataggataatttttaagtgtgttaaatatactgttcaataaaaaatactcattgtaaaaagatgatacacattattaatcaaaaattaaacaacaatacccatattgaattttgctagttatggcctagttggaccatagtawtgtcttytgcataagcatttatggataacgatccaggaacagcctgttgcactcagaagcatggaaatgccattcattcagtagaactatttcaaatttttttattttatttttagaaattcctttcttctgttatatttattttgctgccaaagtcagtgtagtaaagtttgaagttctctaacaccatrctccctggggacatgccactgaaaaagaaggartacctggcacacacgccagtgctctttcttcctgtgctcatggcaggcataattaatcaatccaagtactttctcttgttgaactggttcatttgctacactaaggtagcctttagcattctcattgcagaatttaccgtagcagatattaactcactcttagggtagagactaactttaattagaagcagtacaatattatttctagtttacttataccattttgatgtgatatgctgatggtaatacccttagcccttcccacagtgtgtgtatcctctcttaaaaggcacatcaaagagctgagttagctttccatataatcctatattgaattagtagaagcatcaagatgttcaaagaagcttcaacaactttctaactgacatttgttgttctttgggtcctatagattattcttggtcttgaaagcttagtaggtgtcactcagcatacatttagacagtgtttccaggagcattagagatgaaaaaaggaattttctagttacacaatattctgttcactttttgataaaatctaatatagattatttacgtagatggattataaaatttaggcagtagattttagtctaaaagtcaaatcataatatgaggcactgtgatctgggaataaaggaaactttaatattcatgagccatgttaaattggttacctcttggagaggtagcaatgcctgtgttcagaaatatatttcatagatgcataaagcaatagatttttatagagcatgcaattgattccttgtacatcttgggatgcaccaacacatcactggarctgtgcctgtagttctactcttacttttttttttgagatggaaattcgctcttgttgcccaggctgaagtgcgatggcgtgatctcggctcaccrcaacctctgcctcctgggttcaagcaattcccctgtctcagcctcctgaggagctggtattacaggcgtgcaccaccacacctggctaattttgtatttttagtagagacagggtttctccatgttggtcaggctggtctcraactcccgacctcaggtgatctgcctgcctctgcctccctaagtgttgggattacaggcgtgagccactgcacccagctgtgtagttctactcttgacaaaaagtactcatagagatatctgagatctctctacagagattacagatgaactggaagggaaggtctcaggactactttctggtctatgatttttttagaaaaacagatggtggctaggtgcagtggctcacacttatagtcccagctctttgggaggctgagcagggcagattgcatgaactcaggagttcaagaccagcttgggcaacatgacgaaaccctgtctctacaaaaattacaaaaattagctggatgtgctggcacctgcctgtcccagctactcagaagactgaggtgggaggatcacttgaacccaggaggaggaggttgcagtgagccaacattgtgcaactgtactccagcttgggcaacagagtcagactatctctagwtaaataaataaataaataaataaataaataaataaataaatcagatggtgactaatttctggtcatttacctgcatccttatcaacaaaggccaagcacatcttcaagttttcctatgacttttataagttaccataaattatattttgggaaatatttttaacattgcatggctaacattatcaggtttcttagttgctagcttgttctatctcctgtttgagttttaggatctgttccaaatttttaaaatattaaattttcactattttagaaatgatttctgatatagacccacagtaatgaaagcccttggaactgagaggacttgggaatttggctgtggatcctttgtaacatcttgaaatcggagaaccttctctggaggtttattcatctgtaaaagtattcgctaatggtgccatggcacgattaataataaatgtcctgctggtgtttgcaaagttaaccctgcaggcctgtaagttgtgttcccctcaggttatactgagaatgcaactatctcctagaataacgtcccctcyggaatgttaatgagaaggtagaattccagtataatattgctatcttctgatttcttccaatggtgttggaagaaacaagaatggtgttcaccccaggatatcaaaagggtgcttaatgaggaacatcactrtaagaggccataaacctacaacagctataacagcttcatccgcaggaaagcagctgtggttaggaattagtgattatttaaactcctgacactattcctattttgttaagtattgctttttcacttctacatcttttgttcaatttgaattcatcctttaagtttaatttttgttttaattaaagactaggagttttgaggatctgaacttatattatctctaggaggtagaattttattgatttgtgaattcttttatcctgcaagacattagaggagaggaattacctttatcacataactgtttctgcttactgctgcaggtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattggtgagtaggtgattgaggggtttggcaaggttgccttgggttatgtgcatgtcatgattgtctttaagcatgaacttcgtgatttacaaaaagtttrttgcacttgttagtgttttcttcaaagcatatgctgaaagttgacagtaggcaaatatctttagagtttatcccccttcccctgggaaagactacctagaactcttcatcttcttaaaactcgctcaattcttcaagatcrtctttttttttttcctttgtttttgataagatttaacagttatcatgttgccatatttacttcatctatttctatgggargactgaagtattttaaaggaattaaaaatatggcatttcagccctaaatactaaatactaaataaatgcatatgatattgtattgtgtataaattagatattattcttatcttctagaagataatgtcaagagcagtgcgttttagtgttttttaagtaagagaacttgtttttatttgattgtgaacttatattccttttatgcaattaaagcaactttatgatttagagtctgaaataaagataaaggtctgaaatatattttggggatagactggtttttgtrggtctgctttgttgtgatgtcttgctaaaacatatgataaacttggaattaaggaaaaatgagaattagcaaaataaagaaatttagtatttctttctggaagttaatattcttcatatcatttttattagaagttcaagcaaatattcacctcaaagtggtgaccaggaaaattagtaaagatgctgctcagtttattcatccacattatttttggccaaacttgttacctgtatacttagaatgagggaatgaatatagcatctgttggaaattaaaactttaacctaggtctaggcaaatgaacataagctaagtttactgcctgctttcccaggacttggagaaacacatcttttctagtcagaaacaccagtgggtatagctcacttctggtagcatataaatgagctttcttaaarcacagggttgttgcttgtwkaactcyatcatctgttttatttaggaacttttgggaaaatcataaatctaggatagttttttttttactaagaggtgatgagtttaaagtcaagatgtgtaatcagctaatctgtgcttgatactctctttcagcaaatgaacacatattttcttccttttccactagtgagcaatccctgtggtaccaacaatggtggctgttctcatctctgcctcatcaagccaggaggaaaagggttcacttgcgagtgtccagatgacttccgcacccttcarctgagtggcagcacctactgcatgcccatgtgctccagcacccagttcctgtgcgctaacaatgaaaagtaaggctctctttcccctctcctcagtgcctctctagcccgtggacagacattgaccttcaaggctccaagggatgggagttttctagtgagacaagattttggttaattaacttggttcatgtggaacacagcaagactctcagcctccaacttcagataatattttccatgaatagaaggagcttgctaaccaaactgttatgcctatatatgcaaactttcatagaaaggaagcaaaccatatatttctcatttctaattgtcttaagtattggagccagagtgtatataagtacatactgaaaaattgtccctagaagtaatagaatttcactgtcttttccatgtctatgccggcctagctccttagctgcctatgctaggggatccagggttacacattcaaatccatttttgatcatttgtgtttgctatgaaacatggccacagattattttcttaacaatgtccacaggcccattgataactaggggacctgagttagagagtggcatggagagaggcattaatgcagatcatagcatctaagatgcagaggtagacgattgtagtgattaaataagatatctgagattaagaatctagcatacatttatcgtgagaaagaccctcaacagtttttattgccctccaacttcccaaacaatacttttatatcaccctggcagacaatctcaaccaatcactgctcctagaacacagctcaaaacacccactctttatttgtttattgttttttttttgtggaggaaatttattcatcatattaagagcacattttcagtttgtatttggatcttaagaaacctgttctatcttgccaagttatgttttctctgaaaatacaccattgtaactgagatttaattgatcctcttctagggccacgagagagctcatgcatgtcatttcttggaattcagtgttgacttcttctctccagataactgttgcccctggtgctttgctaaagaagtgctgtatgttctctgtgcaggtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtggtgtgttgagtcgctttatgcctctttttccgacttctatgttgattgtatacgatcatgattctgtgggtatttcctgaatatcatgaactaaaaaccagttcaaagtcctagaaggaaactcaggctccatcctttttctatttttatgaagtttttttttttttttttttagaaatcttaaggtttttacaaggcaaatggttgaagtagacaataagttgtctctactggtggctcttcaccatgtgctgggcattgaatcccctttgagagctaacattgaggaggaaacgagaggtttccacccccatttttaacagggactctcagttgtcatatttatttatgtttccatttaaaaggcaaaaaaaaaaaaaaaagactgagcacagtggctcatgcctgtaatcccaacagtttgggaggctgaggcaggtcgatcgcttgagcccaggagtccaacaccagcctaggcaacatggcaaaagcctgtctctacaaaaaatacaaaaaattagcctggcatggtggcatgtgcctgtaatcccagctacttgggaggctgcagtagaaaaatagcttgatcctggaggttgaggctgcagtgagccgagatcgtgccactgcactcacttggtctcaagaaaataaataaataatcaaataggcacaaaataaaattcccccaaactaaaaacaacacatcaataacagtaacaaacacaaagtttgaagactattttccagtaggagaatagggacagaggaaggtatgcttaacakgtcagggtgttcagttcttatctcttaagtctgtatgcaataaagagatatttaagaatttgggagacagtaatagtcaaaagaagaagtgctccrtgtagtagtactgactgataagtacattaggaaataagtcctctaaaaagaaatcatgatcctgctatccaggattcactgatgtcaattaggagctttcattcttgatgccttccaagctgataaccaaatgtccctgctctcagagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcagtaagttcctgtgggaggaccaaggcatgaccagagcagggagacacgaggaaacttccatggggactgagagaggacatggagctttctttttcagctgatgggatgctcccccttggcactccctgcaaactctggcactgcaaggcagagtatagctgtgtggcttgcaggtggaaccagactctgtttctgaagtggctaatacctccttttgatacatagaatgtctaaccaaccagaatatgataccaagaacttatattttatatatctactgctttctcacttgagccacagagaaatgttatgaggtagggaaggtgggtgtgaaccaattccattttacagatgaggaaactgaggttcacattaagtggatggttacattactgtttagtgtcagacctaacacttcaacccaggttttttacttcaaaccctgtccttccccaaccccacccacaaagttatactgtaaaacaaatgagtggtgctgacatattgagaaaacttaggactatttttctgctcatggtaaacagatcacatctaaaacagacacatatcgccagaggcggtttgcttggtaacatggtcattgttattcctcagtaccacaacctcaatgtgacaatggaaaggtgctttcttgtacyttcagttctgactttgatgcctcctcccttttcagtgagctctgcccatctctgtgacaacttcacagaattcagctgcaaaacaaattaccgctgcatcccaaagtgggccrtgtgcaatggtgtagatgactgcagggacaacagtgatgagcaaggctgtggtaggaggggccacaggggagtggagggagggacaagaaagtgcacatgtcaagtgccatttattagatgagagatgagagtgtatttcccatgtcatcttttctttgtttacctctgtaaaaaaatggttgattcttctaataacatgttacatttttgtagcattttgcagggttaccaggggtatttaatttgtagcactttaagtcatgctgtcattgaggaagacgttattaagatgttagaaacttgtgtaatttcttccaaatgtagaatccttattcatacttgacaagtttaaattgtttctctaattttataaattggttgaaattggtggaaaggggttagagaaaagacttcgtatctatctctaaaaaggatatttccaaattaggatatttcttatttggggattttcatattctgaatgtctctctgattttccctgttatctattggacatctgtagtctctctggtaacatgggaaagccagataaattaatggaatttgtcaagattagtcatagtctaacttgaaaccaaagcatctggagtatgtgtgttgggtttagttggaagagaagtaaggaagatactaaattcttttaagaacactgagtccaattgactgaagataatatgatcaaaatatttatttattatggcatcattttagcctcccataccaggcctttgttgcaaattacaaaccagataccatttcattctttgcatggtttctaccaatgggaatggatcgagtttcaagtggtaggataggctcagggtagctaaaagagggaatgttgaccatgaatgttgctggcattcctctctttgggagcttcaagagtgagctaatacaattctcagactgtctcacaaggaagccartactactttgtgcatttctctgccaatggtttatgaagtctttgcaatgactgctttgcagaggagaggacatgccatcctgtgggggatttccgctgtaaaaatcaccactgcatccctcttcgttggcagtgtgatgggcaaaatgactgtggagataactcagatgaggaaaactgtggtgagtgttcacagtcctatggtccttatataccaccagagctgtgatgtttgctttttgtccataattcaactgtctatgtcattgatcctcaatgggtaggatgatatcaagctgtctgatctctttctttctgctggtcagtacatttctactttctcttccactaaagacataagcatctccttctgagatgtttcaaatcaagcttttggaggaaggtatttactgaagaatatcttttatgtgttgaatttatttacatccaacttttttttccaaaagaagttgaggtgacttatgataaaggaaaaatgtaataagataaatagaatagaaatagaaaaccaggaccagagaagtagagggaggaagggtgctaacccagagacactgcttcttaagctctttccccaaaatggccttcataggagaggagagagaacttgtgtttgcattattacccttcctagaatagttgactattttaggagggctaayagttaattaacaggacaggttttagtttctctctcccagtcgaaggtattgactacaaggcattggatagggaggttgaggaaaggaagccaagaggctgagatcatatcaaattagatggtcagaacacactcaatgtgtgttctgaaaacaagcttaatgaagccctgcccagagtgtatatcactgacccatgatatgcgtcaatttctaattgactaatgaaacacattctaactttgtttaccttttggaagaaaaaagtgatcaccacttgcgataagcaatgagagatttaggaagctgactacacctgcaaatatcagttagctaaaaacttatacaaaagggtaatccaattggcattttgtcttttattaataaaagtcaatgttgaatcctataagaggttatctagagtttcacgaaatagaaaaaattaagataaaatcaagctgggcatggtggaacacacctgcagtcccagctacgcaggagcctgagcagggaggattactttagaccaggagttcaaagtcagcctgggcaatgttgaaagatcctgtttcaaaaaaaaaaaaaaaaaaaaaaacagagagagagagcaagagagaaagagagatcagatcacctttggacaaacttcttaataaaggccattctttacagactcaaaattaaggtgaaaggtctagttttggagggtgaatgatttgcccaagcacacctctggggcttgggacacaggagggtgctgggcacccagggcactatggtcagctcacaagatgtctcctgtatgtgattcctggtgcacactcatggccaggtgcctttcctttccagctccccgggagtgcacagagagcgagtttcratgtgtcaatcagcagtgcattccctcgcgatggatctgtgaccattacaaygactgtggggacaactcagatgaacgggactgtggtaactgtcatttgagaagctyaccatagaattttgtactgtgacagtgtaggggcttcaaattagtgtttataaggcttttagaggaaaattatttttgtatatgkgkaatatgtaaaccttagcataacacagtatcttytgctctgtattttctatgcattattcttaactcatagcagtctagattagtcataattgaggaaaatagcaaggaattttaaacatttaattttaatatcaacacttcttaggagcagattttaatctgcgttagccttgtaaacaaagacwttgatcttgctactattccacggaaagtcaccctaaggaatatgcatgtgctcctatgactctcttgtgtagagatcagatcattgacagagtaatcctaaacccaaagtaatttttatagctctttactgatttggtgttgggtcttaggaaaattagaaaacattgaarattggggaattccgatttctgaggaaaagcttaagagctggagattatttaatattagggagctaggtacttccatctctgtatgttgagtggggaaagtgtgagttttgagaatgtattaatttgctaaccacaagttgtgggtttgctgtgagccagtcacagggtgtagataggaatgtgatggagtaaccactatactccaggtacctaatatctgtctgaaaatgacaaggccttctyggaatgacaatcttttctcttcagagatgaggacctgccatcctgaatattttcagtgtacaagtggacattgtgtacacagtgaactgaaatgcgatggatccgctgactgtttggatgcgtctgatgaagctgattgtcgtaagtccctagacacatatgtagtactgcttacctgagagcatggatatgatagtttagacatcagtccgctgccgcttcttagattaaaaggccataagtattgtctgttcagcatgcactgataatgatcagttcacctgagttctaagtcatcataatcatacatttcacaatggccgttcaagtgtacttccttgctattttaaatggagaatatattaagtaatctgtgctaacaaagtatttatatattatcagctactatacaaatcattaattagataaaaaacatttcaggtaaaaaaatattcaagcaacgaatacattagtataaagaacttgggttgggtattcgaacatattgaatttatagcattaaaatttttctcagtcacacgatggagtataaaaatgattaaaacttgaagggggccagcccctccacacctgtaggtatttctcctcaggtgggatgagagactgagaagactgagagagatcaaaatggagtttcttatgtcttccttttctacatagacacagtaactgtctgatctttcttttccctacaaaaactggaaagccaacatgattactcagatttgagtctttatggatcacttgaatcaatgcaaactgtttatacatcattattgctgatccatcaacaataaccatcatccatgataaycatccatgatggttatcgttgatgatgtggttgccaaagagactttataaatgtatgtgggtaaaaccagtcttgacatttgcctgtagagattaagtccagtgctgtccatgccatggatgattcatgccattggaaactgactgggctctgacaactgcccttaagacatagtccrttcaactttcagacaggtcaaggccactatacatcttgatgaataaagaagagcaggctataatggcaagagccaaaggagaaatagcaggaagcttccccaaagtagtcaatttgtataataatttgaatatgtttttttcccccatggcagccacacgctttcctgatggtgcatactgccaggctactatgttcgaatgcaaaaaccatgtttgtatcccgccatattggaaatgtgatggcgatgatgactgyggcgatggttcagatgaagaacttcacctgtgctgtaagagggagagaaacggagtgaatgggagtggtgttgtctgtcaaatctcattgkttcttacgtgtagcatgtgagcctggagagcagttgtacaattgtttaggaatggacacaggatcagcgttggtgttatttcactgggtcttccagcttcagttctctctgtaacctgagaaagttgggaaaacctccatgtttttaaatgtattatggccttagaaaacaatgtctttaagggaaatgttgcttgaaaacctagtatgcataaataaaggcaggtctgttgtggttgaagtctgaggaagggtagggaggaggctgtacctctcctgctgtatcctactttgggtgcccctgaagtaccctctccaaacccctagagcttcctggagcacctttagaaaatgctaagactttcttaatctttacagtcacttccttttaacatggtaattcaaggccatctaattccctcttgctgaatgatgcatatatatatatatatatatatatatatatatattttaaaccctgcttgtttgtgagtctcaattcaggtacatgtcagtagcagaggaggaggggtatttcaaaatcacatgccctggcctcaccctaggcttagacctgatggagcagaatctccaagaatgaagcctgcacatacgtatttttaaaaggcttcttagccttttagtttagtcccctggttgagaactactgattttaatgaagtgaacgtaaatagagtttgttgcagtcatwttgctacatgctttgagtcattggaggaactctagggtaatagttctcaaaagtgtcttacctggactaggaatgtcagtgccacttgggaatatgttagaaatgcaaattcatgggatgcaccctatccaaatagaaattaaaaatcaagaccaaaagaagtagaggaaggaaaggcattaactcaaagaccctgctttttgagctctttccccaaagtggccttaattttgtgggaaaattaagggcccagcaatctatacattaacaggcccctcaaatgattctgatgcaaactaaagtgtcaggattttgtgtaagtaaaagcccttaacctaggagacaagacctggagaagcactcctgttggaagttcacgttgcatcttccatcccctttcccagcttcatcactactcatttttagcccagagatttgacttgtgaagatgatatatcttagtattttgtttctcctcagaaaactttaattagtgttcattatatttcacagttgcatcccaacatttttctttacttgttaggaactagccttgttttgctttgaacttcatgaatcttgagacacatcttagacatgtttaactttcaaagaagtccttaggaaatctcttctctccataaggtaaaatgcccatagctagtaaaaataaactttggagagtcagagacacagctacattaaaaggtttccaatactgttttataatattgaacttgcctttcacagcaaataattattgcaatagttctattaacaatacttccaagaatcagcccttagatctgaccctttcccctcaaccaatcttattataagtctctcctcttgatccctgtgtgtgataccaaggcggaaggaaaatcagacagcccaaatcctccatgtgaaagacagaccacatgtgaagaccacatgtatgttgagttcactgcatttgtggtacaygcatagtgaaccatgttccctgtaccaaacaagtaggggacctggggactacccttgagttcctcacatctgtacaggcagcagctagaggtctcactctggacagcaagtgtgtcagggtttgattgtgagatatcgattttaaatgtaagaggtgagggaattcaggaaggaaaatccaacacaatttaaagcttcaataaaagactcatgcggtagagactctatgacaactgccatcaggaggatcaaacaaatggcttcctggctgttaggataagagtccatgtactgccagtctgtccagcctcacagccaccattgtgctccacgatccatgctccagccaccgaggcctttattcaggtccagagacctgccatcctcctctctgactcagaatctatgggaagtttcttccaagccttcctctccctaacttaagtcagatcaccccagtagatgtttcatagttgtaattgaatggttaatttgaaaagcctgtttctctactagaatgaaagttccatgaggacaaggactgtgtctttcttgtttcccatcatatctactgcctagcacagtgccttggtgtgtactatacatgtaaggtgtatctgctgattgattaatcaaatgagtaaatgagtgcatgaatgaagcaagcctggtgctgacactggagtattttagatattgacacttagattctactgttaacttgtaatttcatttttctatctttcctttcagtggatgttccctgtaattcaccaaaccgtttccggtgtgacaacaatcgctgcatttatagtcatgaggtgtgcaatggtgtggatgactgtggagatggaactgatgagacagaggagcactgtaagcaaaagtcaaaagggagaaggaaaaaggaaggaccccaagtggtctgcagtttggaaaatgtgcctctgggatttcagtttgttctatagagttgtgcccatgactgcagatctctgctgacataattgtttacaagrccatgcaaacacatgcattgcttacatgtaaccctgcctgtttcttcctgtctcatttgagcatgatgctggcaaatccattaatttttcagtctttgtttgaacatttaataagccttcccctcctcttttctcataagaaactgagaacaaacactaaatactgattgagccacacctcgcaaattaatagtttattttttcaaatatgagatttgatcatccttcagccttcaggagttgctaattgctaatctaggcaggtgcccagctgcagagatcatgtgaagcaaggcagcactggtgttaacagagcttatctaatatccttgttgaaaatgaaagttcatttcccagaagagaaaagtgatagattagtttaagatagaagttccaaactggctgcatttaacaatcgaggcattgaaatagctgtactttttctgcactttcaaaatgttttaaaatctatccattgaaggggaaagttgaccaattttctgggcaatttaatttgcctagaaaatgtcagtgaggaaaatcatttccccgactccaattatttttttccccaaaaagacattatctgggaaaattaagataaatgcctgatttctccactttctatttcttgtattgatgtggtcttagaacgctttgccacagaatgcttacttccagcccccatcccagaggagactgtcagggaggactttgacactaccacaaccttcaagttcgtattcctgttatcattattactggcagagatagcattaatacattatagcattaatatgtttatttgaggcatagcgcaaaagcatgaaagcccagaaataaaatatttttaaagaatttgagcagatttcccccttccccaaaatctctttccatttcccctgctaaaaatgccattttttaaaaaatggagcaagacatttgtagcacatggtcaaatcccagagtggaaaaaagaatccataaacttctattcttttcaaggaacagggttttagtctgggagaccactaccagtcaccacaggaagcaacctgcaacatttcaatggcttaaaatggcaaaggttcatttcttgctcatgtaaagtttaatgacagtcaagcaaccctcctccatcccataattatgccatcagggacacattcaaggttgccaaggcaggagaagatcaacatggtggaggcacacagcttcttaacttcctgagcctggaaatgacagacatcctcttgctcatagtccattggtcagaaccagtcacgtggccctgctctaactgtaagggagactggaaaatgcaagaatatgcattctcatacaatttacccttgtgtcactaaatactcctttatgattttcttctcacacacagaacacccttaaccccttcccaagggacatagctcatagtccattcmgaaactgaaatccaggacctctgggtaatgggcagtagccactcaatcagttccagatgtggttcctcttggttgrgagacccataaactaataaacaatcagtgccttctgygcctgataggtattggcggaacaggggcaacacaatagaaataaacactcccattggaaagaaagaattggagactcatggccatcaccaatgtatagcaattctgaagtcccactgggctgggatgacacatgttagcacaggacagtcctgattcatgtctgctgccccagtggaattatgaatagcaccaccttcactttcaaaagcacactggcttggaaaggagagtaaattacatggccactctgggcagacattgtaaaggtcccttctttggggagtggagggtatttattgattagctcatgcctctgctctgggaggagctcctgtgttaaaatgtctctcactgtttctgactctaccctttgagagttttttcttgtctattttcctctgcaaatgaagagggaaagggaaatatgctaccattagggccagcacggcagctttctcaccccacttcttgcttatagaaggtcgggagcccaggagttgttttttgtttttttttccaagtctcaaacagtcatagtattttggtttatttggttatatctttctctcagaaacataccaggcatttgatctgtttgcttctagcctgttctaaaagttagtaacctgacctagtgctcttttggagacatagttctcaaatctgcttttttctttgctttctttccttcatagagttctgtctgaacttattgtcacttacatccaatccatgtagaaaaatagatgggcagtcattttatccaatgaggaggttttattgggccttcgtgtctcacagccttttaaacttcagacttttactgtttgggatgtagatacaggtggcttttctcacacagcaaatttctgggctttattttatttctgcttgtaaggtaaccagttcttcccttaggttctctctttcttatactatcttgccaaactcaggaatggcaatcaatgcacattactaacattctatcttctaacctcgctccatgattgacaggttcagtaagcatgtgatctgccttccagtttttccgaggtgatagctttatcaaatgctttgactttgcataacatgatctccacctttcctgcctccactatcagtgtccttgttgcttgcctcctgactgttaatccaatgccaaatattttatgtttttattatggcagtactctacttccctcatcactctatgttattcggagtaattaatactagctgttgcaaccagcatatcctgaaatctcaggggtgtaacataatgaagccttattgagcactcataaaggccaacgctggtttcacagccctcctgcatcttgcagctgtgctgcctggaacacatggcttccaaggttgctgcagcagcacaggagacacggaggaggcacgtgtgcttttcattgcttcagcccagtagtgacacrtggcacctccaactgacagtacgttggctagaactggtcacatggtcctaacccagctgcaagggagactgggaaatgtagggaagcactygtttatttggtaagcacaaactgtctctgtcaaagaaggaagtatcttgcttcataaaagaaaaagttttgattttaacttgtttttacatkgcaggtagaaaaccgacccctaaaccttgtacagaatatgaatataagtgtggcaatgggcattgcattccacatgacaatgtgtgtgatgatgccgatgactgtggtgactggtccgatgaactgggttgcagtaagtaaacacttgtttttatagttcattgtagtaactcaggtttacctaattaaaacatgcaataacataatgtagacactgaccacattttctccttaatgtactttttgcttgaattccagtcaagcccatagctagctgtgactgagtgcttatcctagaccagacattgtgtcaaacattctacatgcctggtagcaatcttatgagttagatgttattatctctttcttatgtacaaatgagcaacgaacttagaggttaaacgaattggccaggtcttactgtcattaagaggttgactcaggatttgaactctggtctgtttcactgcagagcamgtcctcttcccagtccactgggtgcctcttagcactttaaggctacatattttgtttattagtctgcacattatggtgggaggatgggggagggatagcattaggagaaatacctaatgtaaatgatgagttaatgggtgcagcaagccaacatggcacatgcatacatatgtaacaaacctgcacgttgtgcacatgtaccctggaacttaaagtatatacatgaaaaaaatcttaagccaaatgcagtatccttggtacctgaaaatccttctgagggtgtttgatcaagaagggaacgccacaggggacctgggaagggacatttatttttatttttaaagttgagggagtggctggatgcagtggctcatgcctgtaatcccaacactttgggaggccgaggcagacaaatctcttgagcccaggagttcaggaacagcctgggcagcatggcgaaactccgtcttaacaaaatacacaaaaatttgctgggtgtagtggtgtgcacctctagtcccagatactcragaggatgaggtggaaggatggcttgagtgcaggtaggggctgcagtgagctgtgattgtgccactgtactccagcctgggcaataaagcaagaccttgtctcaaaacaaacaaacaaacaaacaatcaaacaaaaaagaaagtagagggagcactttgtgtaggaaaaggatgatgaacataaccaaggaacaattctagctcaatattttgatggaaatgttaaaatgacatgttactaagtyacacctttgtagtccatttatgactcataaagtgctttcacatacattatttaatgtgttactcaagttagccccrttgagttgctkttattgtctatgtaataaagctcagagagcttaagtaacttccttgtggtcacacagaatgtcagaggcagaattggagcagtcatgtaagtccaggttaggagggctggcctctggatccctgccactagctgtgccactttgggcacatactgacctctccagtctttggtttcctcacaggaaaaaggaggcccttctccaaactctaggagcctgtgacttagtcatcctagtgagctccatgtgctttcaacttcttgggctctaattgactttttcctgaggcatccaaaggattttctatcaatttttctcctgcgtgagttacgaagaggtatgaataaccagccatattgagttggcttgccatttatttcacatacgttttctgtgggacttggagttattgacagaatgaagtgacttgataaaatattttaaaagcctgaacatgatagaatttgcaaaactgaatggcaggtttgggttctgactcccagagactgataggtggcttaaaatagactacagtactttcttttcaaatggcatttaattagtagcaggtttttgtttktttttttaaggaaataagtagcacaaacaattcgggtatggaagcagcttctcttttcagatattaagtgaatatgtgayatggaattcagtcttatttctctggrctaataatttgaggcatagaattcttttttaatatactagttcttgggtgctgttaatttatttgcctttgtcttttttctccttcctcctcttctccttcttcttcttccttctcctcctcctccttcatcttcttcttctccaaaagcatcactgaagtgtttaagacacattgttcgattttttaaaattgaaggtatacaacatgacattttgatrtacttatatatagtgatgtgttataatcaagcaaattaacatatccgttatctcacatagttatctttaaaaaaattatttttgtggtaagagcacctaaagtctactgtcttggcaaattttygggaatgaaaatacattagcattttttctagcaccattcaggtataaaggaaagaaattaacctcaggttgcaaatattatttatgtgatcataaagatagattgacttgctgtttctctggtagttcttattccttcttcataaaatggaaagtagggtatttcttttataaatagagtgccatatgtttgggtttggggaaatcagttatacgggttaaaatggtgatcattttcaaatgaaaacaatgataagaaagccctcacattttaggaagaatcctacagtgtcgtgtggtttctgctcttgttaaggactcttgcttcacaaaagggtgactcatttagtggatcacttggtccagaaattcttgactcctgggacccctaatccctttatagatttcagagctaggaggaaattacaaagtctagtgatgcatgtgagacccatggaggttatgtgactggctcaatgatatccaagttaataaacataggtcagattcatttagcaatgtagaggggatatcactgctaatctcacagaaattcaaaggacagtaaggaaatactatgacaaattttatggcaataaatcaaacaacttacgtgaagtgaataaattcttagaaagacacaaaactctgaaaatggctcatgaaaaaaatagaaaatctaaatagatgttttaacaatgtacagttgttaagagctcctataataaaggctaggatctttattataagactttcatgcatacagctttgaagtctgcactccaagggcagcattccattgaatttcattgtactttattttggttatttttctttttgaaacccagtgttcttaatgtactcagaccacatatagtgatatgatcatttaccctaaaggactctgagagtgattaagttcacctcattgcatactatggaaaacagatagatataaatctattttgatttgaaagaattaaatcaggagataccacagtctctttggctaaaatactcagaagcctatgaccaggagactttttatttgagaggtagatgaagcttaaatccttaatggagataaccactgcctctctttcccccattatcactcactatctatgttcatcttcgccagtttttctgtaagacctaggtttggggatagatggaggataaaagaagcaaactgataagaatgacaaggatgaaagccagatggcttggatagatattggtagagacaagatcttggggcaatgatgaacaatgaagtgttagggtaaagtgtgagctgttaaaagtctgtcttggaacatctggatcagaataacagggatcatttatatgggctctacaaaaataaactgtgttttttkttttttttttactgtgaaagttcaataamaatcaaaagtaaaaatcatttgaatcccatcactaaaagagaactaacctttaaagtttggtgtacttttgctatcttttttttgcatatgtatatgtaagaaatatttcttagtattttgaaaaattaagaaatattctatactaaatggagtttttcagtctttttttcaatttattataggtatttcccatgtcaaagtatcatttgaaactataaattttaataatcacatagcaattcatcatgtagataatcataacttattgcttctaagatgtatttttttatattttaacatctttgaaaccaagatatatatcttacaattaataacatgtcagcgtaagttccagacatattcaattttagtgttacataaagtaatggtgcatcattaatgtcttagtttttttatactataacataatttattccctatcactgaacatacattcaagttgtttacaaatgttcttattgtaaatatttttataatccttaaacgtaaattatactgcatattccttctcaagggaaaattcattaacatggaataactgggtaaaagagtatgaatatttttaaagtccttggtgcatacatacatagtacaaaatttctttccttgtgtactaatttatggctctaagagcagttgtatgatttagaactctatgtattttactgcamcctggtcaacacttgatatacatgtatatatttgtgtgtgtgtgtgtgtgtgtgtgtgtgtgtgtrtrtgtatataatcaattggtcaatgttagggaaattatagtcttcttaaaattttataatttcctcctatttgtaactttgttctaacctatctgtatccatgtcttttattwatttatttatttatttatttatttatttatttatttatttctatctgttatctatctatcgatctatcatctatctctctatctatctattgatctatctatttgcaataggattaaagatagtagagcaggtggtaatagctgtagagtgtcaggcttcatagttgtgcagtccagaattggatgctctgaggataagcctaggagtgctgcatataatgtgaaaattgcctcamagttttagcattatatgcatttatctaaatggtattcagatcacgatcagaaataggaatcctgactcccccagtgccctctgtcctctccaaggcttatggaaaggggttatctcaagatgtcctatagttggttacgagtaggtgcttcttttgatacaccacttgactgttatttgtggctgatctggtttgtaatgctgggattttgtttttcagataaaggaaaagaaagaacatgtgctgaaaatatatgcgagcaaaattgtacccaattaaatgaaggaggatytatctgctcctgtacagctgggttcgaaaccaatgtttttgacagaacctcctgtctaggtagagtatattttttccaattcctgtttaggtgaactttacatctaaggttctccacccactcccctttgttaaataaatcactatttaattcccttaatggtaccatactcatggtttcatggttctaggtcattaaactactcaagaattgctttcccccacctgcatgcatgctatctgaccagtgcctacctgagtgcttgtcagatactgtgtgctcagtagagtctgtggaattgatatgaatgatgaaggccttggtgatgatggctgcttattgcaccagtgtgtgaaatcaaagttaatttaaaaaacaaactaggcttactttcttcattgtaagtcaaacaaccaacacgtatttattatacacctacttacgccagacatagatgagttgtaaggtatggagtcagaaggtagcttatcaagatggtgagtgatgagcatgattttaggtgccttttagtatttgaatttactgtttctaattcatgatatgtcatagtcagaagattgtaagagttccttttggacttgaagcttaagaactcaattgaaaaactaaatcaatgactcctgttcctgaagctggttagcagaagtgaagagacaccgaacaatacaacacaacatatgccttctgaaagggaaaatgtgctctgctattgcagagtcatagagtttaaatcctgtctccattgcttatcagctttgggactgtgggcttaatcgtccatacctcttaaagtcttttggcaagactaaacgaggaaaatatttgaaaagcatgtgaaacagtatctgaaacttagtgtttcacaaatgtttgtatcattgcttattttcatctgtacccttctcggtcctcattgctggtgaatatgggtttaaacagaagcaagatctctaaggaatggatgggaacagatgttgcgtatttggttttattttgcctacagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtatgatgggttcatgttgggattaattgacttttggggaaataaatactgctaagtacactatacgatgaaagaaacttcagcttctcatagtttttcttttctttctttttttttaaactcgccagctgcttctcttccaacacctctttagtcgctccttctctctcctcccctgccagcttaaaacaatagctacatcccccaacaaatatgtagcaattaaaacaagagccaggtgttacttattataatggatttagcctcttgtctaccttgataaaaacttcaaaaagtggacaagatgtcatctttcttaaggctcaaacaayaacaaaagcttgcctatgggatggtcatcaataaaaggaaggtaacaaggccctctagctcccactccactgagaataagatttgaggcccagtagtccaagagggctcgtgaattggggcaaatcaaggacatatcccttttgtattgttcatggactactgatcacaggcagaaaggagtctggcacagtcataacttcaatcatgagttttacgttttaggttgatgccagtgtctgacaatcgggcctaataaaacagagaaagaatgtaagtcagatgtattatactccaaattccagaggcctgatctaaatcatcatatcctagttaagaggcatgggtctttattttgaatttgaagtttgtactagagtttaaggaacttgataagaaaatagcactttattttgtaaattaagagtaaatggccaaaatggctgttcaatttcttcatacaaattgagcttttaaagcatacatttgactagcatacttacatattttaccctcaaaacactgttgacagtgaatgaaaactagagtgaaagcatttgaacagttggtctggtaattaagcagcaattttttaaatgtttaaatcctttaactaaggacatgactgaaacaaattggaatattcatataaaacataatgtcaagatagaggaaatatataaaatgaacttttaaaagttacttaaattggattcagttgacattatgcaagtaaattaaacttaacaaattctagacagtgcatcttgggatgagtcaccattaagtagctgctttaggttaaaaaaattaaatcaaggacaagctaggtttattttgtcattagctaggagctaaattgggtcatagagctgattacctgctaaaaagaatcataaaatctgtcaggaaacagtaaggaatgagacttttctggtaaacttttagtaagactataaaagtatttcttctgtgagatagaatgtctgcagtctwgtctgttttgatgtcagtaaataaaaacaattcagtgaaaatgaggactstacgtagggttctcagtctagctttgttccatactaccactgagtacaaagaataaagaactgataatgtccctaagagacatattagctttccacttgaagtggagaatgtcaagtcacggattttgtaacccagttggagagtcagctttattgattaacagagatagtcagattcctataaaaactcatgttctttaaaaaggggacaggtacatactgtgcattttatatcctactttatataggaaagtataattcaaacagataaagtagccctttgtttgtttacaggtagctctcctttgttgctactgcctgacaatgtccgaattcgaaaatataatctctcatctgagaggttctcagagtatcttcaagatgaggaatatatccaagctgttgattatgattgggatcccraggacataggcctcagtgagtataaactttggcatctttcattgatattaagtgactttatagaattttaaggtgttgacttttaaggaatttattgtttaatgagtgaattttgttgcattagtggaggaggaaactcttccaatccagcatrctcctgatgccttagcgtggccttgaatcccagccaagctttcctgatttctttctaaaactcctccgatcactggggtttatcctttctggaccatctcacatcttcttgtattttgaaatttccttgtccttgatactgcagatcttgttccttcctaccattgtacaccttgaaaatttctactcagacctcaaagacccagtttaatgtcaccacctctgtgacaacttctatcactccttctggcagagttctwtgattgctcaccatgaatctatgtcattttatggcacatgttactctaagttatatagctagttgaccacataatatctttctatcctctagacatctgctttttggggacaaagactgaatctaatttatctctaaatgcctagcagctgacccaacatctagtacactctatgtggtaggtgatcaaaaaatttagttgaatgaaggaaaaagatgaataatgcttattgttgaatctctcatggctctatctggtgttgggggagatgacagtagggtaggagtcagaaaacttgtcttctgtgcctgtaaacttatcttttatgccagtctcccttatctactagctttgtgatcctaaataattgtaacgattctctgaatctcaattttttttctacaaaatcaaagtagtaatcttgttctgtctgcttacctctgagagttgtttggaagattgaatgagatagtagatatgaaaggctttgaaaactatcaataactataccaatgtaggatttattattggtgtattttcacacatattcatgcaatacaatacacttttcaagaatggtgcatacctaggaaagcagcaggtgtccagtgcatccctctacagtcacagtcttcctatgcttttaacatgcctgctgtccaccatccttctgtctgtatataaaataggacttctcgttgacatggcttctttattgcctctgatcttgagtatgctttcaaattctcaacagcctgccctggtttatctctatacattctgttttggaaactagaacttgatcctaataagagtaaataarcactttgttgaaatacgtttaaatgaatcacttttaaatagagatgactaaatctcactaagttctcagttgaagcatttgtagctcatagctcaagtttgataggttttaaagtttgattatactgatgtcattgaattattcatattataacaacagtgaggagggaggtagagatgtcaataaacgaacagtacttcacctgattagacccctgttcttcctttacttgatgctcttgacatgaaactgacctgtgtgtcttcctctgtaggtgttgtgtattacactgtgcgaggggagggctctaggtttggtgctatcaaacgtgcctacatccccaactttgaatccggccgcaataatcttgtgcaggaagttgacctgaaactgaaataygtaatgcagccagatggaatagcagtggactgggttggaaggtaaatttgccatacattccccccttacctgttctgttttcctggttagagttctctactgcactccatgggccatgagtgagtctgggcctggatatgagtacactcagccatgggtgcagctgggcagtggttgggcttgctgaagccccagcaactacctccacttaccccagcatgtcatggagacattatcatatcctgtattctttgtgggccatgaaaaaaattgggaaagcacccaggtcaatatctggatatagatattatatctaggatataatagtgaatattatatttactataagtgaatagcattcttgccaacagagttctggattccaaaaktaactttcagtatggcagcactgctcattttgtgaagaaatgggacagcctcacaattctcccagcaaagcagttgagatgaaactttttttctatggtagttatcttggggacgaacaatccacatcttgtgtttttagcaggcttctagttaaaacagattggaaatttgactaaagaagtctttggaattgagttaatagaggtgtcagtctcttctgttcttctagaccttctagwggcccagggaccagagccacacattttggatggtttttaagtagaacttaagtagggttatcatcaggtaggtgtgygaggtacaaatggatgtggagaagttagtaagctcattcttcaaggaagaggtttgcactgacttacattggtgggaaaatgattccttgaaaatgaaccaataatgcaaacatgtttgagggggaaggttcaggagwcactactctcctggagaatggatagttattttcagtgtaaattctttttcaccttttaaaaaatgtggctggtgttcctggaagagcatctttgaagaagctaattgggtcccgctgtgyctgcaggctaacaggagactcattttagcattttcagtcaagaaacagggccttagagtactgttgctagagtcaggaactcaaaactccagacattaacactctcttctgaaaaccaaccagggaatggcagatctgtcttcttgtttgaagttttacctctktctcagccttaatgaataagagaattaagaaagtggtggaactttttctgcttgtaagagactgagacctgcagcctcagaagtggaaataaggcaggacagtcttgccgagtttgttattttaaaaggctgtttccactcatctttgagctgacaccaggttcctattgattctaacggggctctttcctgaggaggaaacagactcatgggcagtcagagttaaggcaccagccccaccgtgccttatgacttctacctagaagcccatgtctcataataatgccagtcagaggccagtctgactgctgtgtctatggtagttatcttggggaygagcaatccacatcttgtgtatttagcaggcttgtagttaaaacagattggaaatttgactttcctgtttagtctttggaattgagttaattccattgtggatcctgcgtgattcaggtgctttggctgttgggcaggagtcccctcaattccttactcttccaagtgtaacctgccaaacatgtccccttggctgtagttcycccaagagagggggactatggtctgatgatagktatctgagcagctgtctcaccagccaaacgaaatgctctcatcttcaaacctcttacccagtaatgattactctaggctttgcagttgtttaactttgtccctctgaattcaggcatatttactggtcagatgtcaagaataaacgcattgaggtggctaaacttgatggaaggtacagaaagtggctgatttccactgacctggaccaaccagctgctattgctgtgaatcccaaactagggtaagtacttggagaagtcttcaacatctagatatttctccctggattctcatcaaattccatgtttcttataatttttttttcctagtttaactgaaattgtccttcaagtttttgggagtagcgtctatgactgtttcaagaattataacatgcccttgagatcatatagaaccaaccatttctgatggggaaattcctttagaacacatctgagaatctttctagttacatggattccttgccaaatcagagctctgaactctaaagttctttgtggatataactgttttaagtgaaggtttcaacagaattgtttttcctttcatttggatgttttaaagtaactcattcattgaaatccagctagggatttggtcatatttcatttaaaaattaaacatttatatccaaaatatataaatatttaaaatgacacatgtataaatatatattatccatttgtakaaatattccaatttgcaatttatctataaatcatctcagtgtaaatgagaacaagttttgttatttttctctacatttcaagacatttatttgaataatcactaagctgaaatgacttggtatttacatattagcttagcttcagaatagtgacactttaaaaaagttttttgaatgaccccaaataattttcctacttgggcaggaccagtctagccctctgtagatatgccagtatttgtaggtagaaccctatgagctgttattactttaattctgttatatttcatatgttaaatcataccctcagaaactcagcaatgaaatatgaaaaatacttgactgatgagattaacctgtagtgaggacttgtcctcagcattagtcattgctgcttatatcttatctacacaatatattaggagcaaagagatgcagtgtgttctatggtgtgaatgatgtgactgtttccagtgtgccgtttaattttttcctctgtaactaatgtttaaattcatctgatattattatcatactctgatatccctccactgtttttttcatagaaattcttttttttttttaatttttttggagatggagtgttgctctgttkcccaggctggagtgcagtggcatgatctcrgctcactgcaacctctgtctccaagattcaagtgattctcctgcctcagcctcctggcagctgggattataggcacccaccaccacactgggctaatttttgtattttcagtagagacagggtttcaccatgttgggcagcctggtcttgaactcctgacctcaggtgawccatctgcctcgccctcccagtgtgcygggattacaggtgtgagccaccacacctggccagaaattcttattttagtctttgtaattcctttctctctggaatggctcagtgtagtcctgtgagggataggaagtaagaaaggagtgagaaagggtttcactgcctaaggcctgcagacccgacctacaacctcctcatttcatgatccatttgaaaggctcatcatccataagttttataagcataagcatatatgatgtgttgaaccttcttacagcttctgcggtataagatctgccagtgggtccaaaggatgatgaagatgataactactgataataccagcaacagcaatgagaagtgccaacatttattctattcttgctgtgtgccagctactctgctaagtgtcctacatatataaactcatttgaattgtacaaaggatctataaattagtcataggtttctatcccttatttacatagatgggtaaaataacaccatgctccttcagacagcaactgttgactataatataagatacaaagggagaattgtcatgaggacactgctgaaaaacactgtgatagttctcctaccttacaagggttcagggaagctctatggaraaagtakcactgaactgaatgttgaaggttgggatccactggtagtataaccagtgataaagtatgtgacatgtgaggtcaatgtgggtgagagtgagaagggccacttcccagagaaagtgggactgacatagaacctagatggatgtcttgggtaytgataggcaaaggagccaggccggctgttcagaagcycaggcaatagcataaacgaagtcatggaggaaacaaaaatcattctgtgtaccttttgtgtgttttttccattccattccctacgttttgttttttttagttttgagtatttaatactttttaatttaaattaaattgaattaattaatttacttatatagacagggtcttgctctgtcacccagactggagtgcagtggcatgatyatagctcactgcagccttgaactcctgggctcaagcagtcccctgcctcagccttctacttgcacaccaccatgcctggcttattatctttaagaaaacagcttatataattcacatatggtatgtatggtatgatacaacttacccatttaaagtgtacaattcactggcttttggtatatgcagagttgtgtatccatcatcataatcggttttaaagcattttttcatcaccctacaaagaaaccctgttcctctgagccaccattttyctgccctcagtacctgctaatctgctctctgtctctatagatttgcytattctggacatttcctacaaatggaatcctacagtatgtggttctttgtgactagcttctttcacatgtgtgtcctttttaatgaaaaccaaacaaggtggtatttaccagttgttgagactttaaaggcccctggctgcattttttccagagcccagtttgtctaaaatccacacattcgtcagtagaatttaaaacttggcctatgcctgatgactggtttagactacaggctgcaaagcagcggctggtgggccaaatatggyccataggacatatttggctgggacaacacagagctttaagatttttttttttttaacatagtgctgacatttaaaatttaagaaaagaaagaaaacctgtatttcttgctttggaaatcagaggagcggattacactgggtaggtctgccttcctgggcactgacaggagctcttacacagggtcttgctctccgcatcacttgatatttacaaccgggatctctcctcattcatcttacatacctgttcctctccaggtatttgaaatcatgcaatccctggtctaggtaattcaatgtgagatcatctttgcttacatagacccttgctctacaattaattattaattggatgcaaaagacatatttaaaaagagttgctgggtgtggtggctcactcctgtaatcccaacactttgggaggctgaagtggggggattgcttgagtccaggagttcaagaccagcctgggcagcactggtcaaaccacgtctctactaaaaacacaaaaaactagccaggcatggtggcacatgcctgtagtcctagctactcaggaggctgagatgagaggatcgcttgagcccaggagtgtagtgagctatgattatgtcgctgcattccagcctgggcaacagagtagctccatgaagatagaaatctttgtatgttttgttctctgatagatcccaaacacagaacagtgcctcttacacagtaggccttcaataatatttcttgaagagtgaacagctttcataatacagctttcataatgcattttaaagggtctgaatatccatccttcggccaatttctattaaggaggtgcagttttcaagaaggataaatcatatgtgctcttgygcccctatttttgctccccatcttctgtaaaatataaaactggtgtcactgagcacccaggtccctgagataaacagttggtttccctgtaggtaatgccctgtgctctgctgtagtggagaagtcttaycaggtgagatgctacagtgaagaaatcttctgttataggcttatgttctggactgactggggaaaggaacctaaamtcgagtctgcctggatgaatggagaggaccgcaacatcctggttttcgaggaccttggttggccaactggcctttctatcgattatttgaacaatgrccgaatctactggagtgacttcaaggaggacgttattgaaaccataaaatatgatgggactgataggagagtcattgcaaaggaaggttagaaattarttagaaagtaatatattaaattaataattaacatatttctaatgtctttgcctgttttctcaagaaggagccctgctcttaggaaatggcttatatagttttttagataccacccctccacccccaccaactcccacctgctgaattaaatgcagatgagttcattagcaataattaaatccttttcgtcctttttacacaactttaaaaaaaaatgcttctcagcagaagatattgaaataactgagtttcctgttaggttgccccagtagaggtggtttcatgtgtaccaatgttaattcatgtctaaccgcttctggacacattcattttcactttactagattgcccagtatgcacaactgtaaatatctaggagatgaacattttttgttgttgttgttcagactctgcagaattgcaatgacccagcacatatcacatttttcctatttggtcagatagatgtcttatgttcaaaagaaaacataaaatcttgccatttaaattgttttccaaaaatgcagtaaaatcagtaacttgaaagtgagctagggccctgtgattggtgtcgggtggtatacatcaatgtggtttaatttctatcttcttgacctcctaatgcagcacactttcacagtcccatgtagctaaagtcagcctgaatattcccagagcttcaaggcattgtatgagggaataattcaagcagaatgacatcagatctagaagtggcggtagggtgtagtgggtattttcttttcaataaccttctgttttgtttttcccctgtgggtaagcagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcaggtaatcaccaactttggtataagatgctcctcattacttggaaatcttatttcaaaataatggctatattgctggaagatggcagtagataacaacaagctaatctcttggtgcatgaaaggggtatatgtgtatgtacgtttgctgggggagaggaacgttttaaccattttmaccaaagaaagataaaattggwggtcaaatgaaattatgcaaaccatcagcaggtaagtaaaaatattagccctcatcattgtttggagtgatggatatgtacttctaggccacagaatccagcagacatcagtcccctgctaartgtgagttgggttaacaagtcacaaaatgggtttcataggcatcagaaatcttatccttcccattgcaaggctaggctagtcaggtcaacctgagatatgtaggtcttagtttaaaatggccagtcatgtgcattcctacccgctcccctctgtctcactttcccacttctgggccctgcttcctcaggttacctgtgcgctaatttatccttcagcagtgtgtggagcaagatgaaaggcaaagggaagtgaggaaaggaaatagccttttactaagttcttrtgtcaaattctctcttcagtgttaattcagccatctattacttcaattaccttataaagacctcccaaaccttataaagacattttattctcatctcaaataaagaaactgaggccgagacagatttagtaacttgtgtgcctaagtcacataacaaatgggtgagttttaatctcagaaatgaaataatttttaggttcaattctatccaacccaaaactcagcatcttgctgtattggcccagtgttcagtatgccaaagtcccaggttgaatgctatggatatgtggcctttgacaagttactcccttcctgtccccatatgtgagtcatgggtggagtcyggggttgtcttgagtctgctgatattttgagaccttgatcagccttgaaaaattgcaactcaaagctgagactcccatgagatgacaggggtggcaaatgccttttctagggcatggcttccttgttttggaagtatatcaccaaaacactccagaatactccagaccctaccaatagaatagcttttgtgtcctaagtgcccttgcggctctcacacttggcaattttaaaggtaggagaggaaggcacagtacacctggaaaggctatctcccctccctaccgcctctggaccctgaggagaaggcagaggaaagtctggaggctgcccctgaaggaaaagcatctccctccggcagctgatgctcagggaaggcggctcctttggaaagtgctggtggagtgggggtgggggtgggggtggggatggggagtacagccccagcccagcctgtttgaaccaagagttctgaaagttgagcatgcctcagaattatctggagagcttgttaaatatagattcgtgggccccatctgttgcacttctgatgcaatatgcctkaggtggcctaagaatttgcatttctagttctcctgtgacgttgatgctgctggttcagtgaccacattttgagaaccgctgctccagtcccttgctactcagagtgtgggccatgggccaggagtcttgggatccttatgggagctggctagaaatgcagtctctcaggcccaccccagaccttctgaatcagaatctgcattttagcaagattccccaggtgatkgatagcacattcaagtttgaaaatctccactctggagggccgacgaaatggtaatgagacagatattgatggaggcttttggaagatgtgttactaatttatagctatgctttgtctgtggttacatcttgaatgacagacaatcaggatcacagaatgttagtctgagaaggaatgtaaagattatccactccagtacaacccttggataaatcataatacatgctaaggtagaattaataaggctctagacttacctagggagcttttaatggtaatacttgaactctaccccagaccaattcaaatctgaatctctgtgaatgggcatcaataggtttttttgtttgtttgttttttgtttttgagacggaatcttgctctgtcgccctggctggagtgcagtggtgcaatctcggctcactgcaagctccgcctcctgggttcacaccattctcctgcctcagcctcctgagtacctgggactacaggtgcccgccaccacgcccagctaattttttttttgtatttttagtagagacgaggtttcactgtgttagccaggatggtctcgatctcctgacctcgtgatccgcccaaagcggcctcccaaagtgctgggattacaggtgtgagccaccgcgcctggcctggcatcaatagttttgaatagctcccaggtgattatgaggaaccattgctctaaattcccttttcttgcaattaaggtaactgaaacccagaagaaatgtctccttggagggttggggtggaaatcacatccagtatactttggatagaccataygttatgatctgtccagttttgggtagtgacaaatcttggtayaatatgtggatctcactggtcttttgaaccatckcaagttgtttagcactgagtagattttgaggttaggcagtgaaccagatacccaccttccaaacctctcagggcagcagagaagataagtgatgccaatagaaaatgtgagtggtacagaaattggctggagggcccagagagggactatcccactgcagtgtggtggcagagatgatagtgtaaatgagggtgagtggccagctgacacrtggaygagaggtattgagaggatgcctaggctctgctgtcacctggcagagccacttccagttgctgggtattcaggttattcattctgtcaggacctaactgctgttctcacccgctttccagtgcccaacctttgcaaacagatctgcagccacctctgccttctgagacctggaggatacagctgtgcctgtccccaaggctccagctttatagaggggagcaccactgagtgtgatgcaggtaggagcactgcccaagcagctatgggggcctgggagcactcctctgctgccttcaggagtcagaagaatccctgtatgctgggtcctttgcagcagagtggggatggctggaaggagggttaagggatgtgggaggtatgaacagagttgagtgggacttagggggcaaacagaactgtgttccagtgactgctgagaattatttgctaagatctgcagaaatatagatccagtgtccctaaatctattgctgtgttgttttgtaaagacattttgaagagtgagtttttataagacctctacctcaagctggattcccattgccccagaatccactcaaccttaattgtagctcctcagggtagagaaccatgtycagttttgacaactgaaaaagggctaccttttgaaaagtgctttatattatcaggagacgaagaccagcatgaggaagctgtggtttaattctagtcccaaacgctgtgggtgatctattcttggcaagactttttttcaatgactcttttaaggagttaataagccggatgggggcgaataactagtgtccctaactagcatccggtgctggaaaagcctgtgaaaaagtcgtcctgcaattcactagcggcccattttatggctcacatccttggggccttcccccagttttagctgatggggaaaggaaaacgcttaaccaccttctaccaccagggggagcaggcagttagaccaggaaccaccctttgactcattccaaacaggctgaggagttggcaggtttagggaatgaatccagggagaaaaaactgyttcttgtcacccctcttcccctactcttgcactcatcccaacgctactggggaaatattggtaggaatccaatatttcgagccatatttggaacaaaatgacaatttcaggctttgagatttgttccatgctgtggatagattgttttgccacttactgcaatttcacatcgtgggagcagtgtggtcctggttgtcacctcatctactacttttctcatttaaactttttgccaagtggattttattaagattcttgttttaaagaactttaaccgaagtaagcacacgaatgatggcagtcattccatatagggcctcggtttggtataataattaagcaattagtccagtgagatttcttgagtgccagctatgtgccaggcactgttctaagtgctggaggtaacagaggtgaacaaaacagacaaaaccccctgtgtgtattgagtttacattctaagaggacaataaatagagaagtcaataaatayatggtagttcaggtggtactatggagaaaatgaaggcagaggaagagggatgaggatggggtgagtggggattgtcctttagatagtgttcagggaagacctgtctgatacagtgaacattgagtggagactcagattgaaggactgagccaggagggtatctagactctttaaataatatacacatgtaacctatacttattaagcatcttcaatataaaagacactgaagcactaattccccatcaggcacaycctgggagtatgtacaggcctagctgggagcagggacttggagtaagggcagtttgggaggacttgaaaactcaggagctctctagctaactgcctatcaaatatctctatatctgtagctatgtgactgcctgtggactgatcaattactgatgctttggtgtctttagttgaagtttcaaggtgggcctacattaaactcttgattttaactgggttcayggaggagaattctgaaaacttcaaatgagaatgtgaatattttaagagattattttaccactaggttcttgtaactattaatatatgtgctccagagtctagtacctctccattgttttttgggaaaaattctataaactgccccctttctttccactaaatgtatgttactctccaagaccttaaggaaactcactggacttagggggaaggtaagctttgacagggagactaattggctggcctgcccctcctcccacccctaacctgggccggtttgcatggtgtgggcactctgctgagtacagctgactaacacctgcatggctttcccttcctgcagccatygaactgcctatcaacctgccccccccatgcaggtgcatgcayggaggaaattgctattttgatgagactgacctccccaaatgcaagtaagtctgaatgttgaggtcccrgctataggccttgcctcttctggggaaatttgagaccttaaagtagccaggaaaacaaatacaggaacctcaccagttcactaattcttacattttaaccagcttgccttcccttgagggagtctacagagaactgaggcagtgcttctttaactagaatgtgcataagaatcccgtggagatctggttcaagtgcccattctcacgcacagagattctgcatttctaacaagctctaggtaggccacagggtcttggaccacactttggggagcaaggagttagaraattggcagcagcattttcctactcacctggtattgttgattacaacagggctgtgggagaagagctgtctgcagggctgctttagtacaaggcactsgtgatgagcagaaagactgggatggattcggaaagaagatgactgtgttgcgaaaactctaacatggagcaagataaatggatgtctttaaaaagcatttaatgaaagcatataaaagaaagaaacataaccatggtttccatttgtactctctaaggaagcattgcatagattagacaccaataggttttcgtggccagactcaccccctcagtgccacagctactccattacaagtgcatttctaaaatcagagcactgttctttctgcttgtcttctcttggcagaatgaacaaaagtcatgcaggatacattgtctgttcaacatgtaatttatgcagtcaaagctctctctacttcaggatgtgctcagaaaaatgcagtagaagcctaagawcataacagctagtgaatgatttgctttttcctttcaggtgtcctagcggctacaccggaaaatattgtgaaatggcgttttcaaaaggcatctctccaggaacaagtaagttttaagaatgtgagcaacttggaaattactcatggcccctacattgaatgctgtcacagcttttctacttmacccagtctttgaaggagtggttctagcccccagtttctgccaggattgcgggctcccatgtgttgatgtgctctctgctatcttcttctatagccgcagtagctgtgctgttgacaatcctcttgatcgtcgtaattggagctctggcaattgcaggattcttccactatagaaggaccggctcccttttgcctgctctgcccaagctgccaaggtcagtttcattatggggaacgttgatgtttgaagcctaagaaattcatatgaagccatgtgaaggacttagttttctttctaagttaaaaaagcacaatacgcagttcaccgattccacagaaacaaaaagtagtgaggatgtaaagcagtcacttcaaatcccaacttcttagtcaartgcttctctaaagcctgagtgacaagctgtgttttgtagtccaaatggttgtgcctactggtaggtgttcaggtcagagaggagtgaaaaggcagctgtgtgatggcccaggctttatccttctatgtgctggactctttttcttttagatctcatggttcaggaatgtgctttaacgtttccaggtagctaagggaacttactaccatatttgacagtgtaaatttagagtgggaattgagcattacatttgaggaagatttggcaatgtggaggagagggtactattgtgaaaggttgtatttgttgtttttgttgttgttgttttaaataacaagacactgttttggttacttctttccagcttaagcagtctcgtcaagccctctgaaaatgggaatggggtgaccttcagatcaggggcagatcttaacatggatattggagtgtctggttttggacctgagactgctattgacaggtcaatggcaatggtgagtatggtttcaaaatgattatttgaaggttgtcatttatagaataaatactttttataaaraacaaaattcacctagagaagactgaaatacagtattaggcywctcagaataaggtctgcactacacaagttaggaaacattaggtttgttgctgaaaggtgtctaaaaacattggtaataacattggaatttacccctgctctaagccacgctgttgaattggaatcatgaacagtctgaagtttaacttgaatattgaagagctttctggtttttttgagggtggtgtgtgaggaggacatgatattttgtttttatttgatgacttttatatgtataaaaggagtagggaactatatttttcctagtgtcatatatttttctgccaatgtatagtgatgaaataaacagtgattttagagttggcgttggtccagaccacggctctgccacctactaagtatgtgacaatagacatggagcttgatatctctgaccctcattgtccctatttgtaaaacaggtaaaataatacctcctgggaggaccaaatgaaatactttatgagggggctgccacagtcttggcactgagggggctttctgtaatcagtattgggaaaccactttcagaattttgtctctccctcaaatctttcattgttttccttccctgagaatattatattatccattctttttccttcccctctctccttattcttcttttcttcttccaccattatccttttctctgtggcccagacccaattcccaagtgagttatttaagagaatttggatataagaagaatgttaccatttccttgagttggtaaattagtgcatgttatgttactttgcataataatttgccatatggaggtcttgtgttttgctggcctttttttttttttttttttgcaagttctcttttgggtaacttatgacgtagcacctagcgtacctccaggtgtgaggaaggcacctttctttgtgtgtgaaccagattagtatggtgtaatctctctctstgtttctctctctctctctctctctctttctgtctctgccatcagagtgaagactttgtcatggaaatgggraagcagcccataatatttgaaaacccaatgtactcagccagagacagtgctgtcaaagtggttcagccaatccaggtgagaaaccatacagtcttttctttcagttactgctgtcgctggatcttaatctattgagtcatgtcttaggattttcctaaccttccctccaaagggaaggaagcatagtgagtggtccatgctgcagctgccctatctgcaggaacaggaccaacccaaggacataagacctgaaaacaatcagaatcctgttctgttgcacagtggtggaggtttggcagccatgccggggctgctggccaagaacctttcattttgagtggtgtcagagcaagagaggtctgagtcccttcaggggcctgggaaacacagtgcctgaagcaccacagcttctctacaaatacttgtgaaatgaatgagtggagaattgtcaggtcactatacaggaatttggggacggggcccactctctggttcttgctgctatcccaagcatgtggtttgaggtggattaaagggagagggacctcttatgcttgctgttgccatacttttctgaaaagtacaaaggtctctagagttgatgggcagatatctaaatttccttgttgcagccttgttgctcagtcatctttttttgtgtgtgtgagcaacaaggctatttatttcacctgggtgcaggcgggctgagtccgaaaagagagtcagcgaagggagataggggtggggccgttttataagatttgggtaggtaaaggaaaattacagtcaaaggggggttgttctctggtgggcaagagtgggggtcacaaggtgctcagtgggggggagtttttgagccagatgagccaggaaaaggaatttcacaaggtaatgtcatcagttaaggcaaggacmggccattttcacttcttttgtggtggaatgtcatcagttaaggcaggaacaggccattttcacttcttttgtgattcttcagttacttcaggccatctgggtgtatacatgcaggtcacaggggatgcgatggcttggcttgggctcagaggcctgacattcctgccttcttatattaataagaaaaataacataaaatagtattgaagtgttggggcaaagaaaaaaatttttgggggggtggcatggagagataatgcgcagtgtttctcagggctgctcaagtgggattaggggcggtgtgggaacctagagtgggagagmttaagctgaaggaagattttgtggtaaggggtgatattgtggggttgttagaagaaacatttgtcgtgtagaattattggtgatggcctggatacrgttttgtatgaattgaaaaagtaaatggaataagagaaggagaaaaacaggtattaaaggactaagaattgggaggacccaggacatctaattagagagtgcccaaggaggttcggcatagccctgccagcaaagattatttatttactttaagagggagttaagagtggcggtttggggatagcaccacgagatatcagctgtgacggcttggagaaacagtgtaaaccggtggtataaacaagagcagggcatttatgagtagttgagaacggtgaataggagtatgactagacagaagatagtagggatgacaagttttttggggtgcagtccaagttggtctggtgtctggaatgagactggggcttaataaaaaggagcgtctatacaggagcttaaatggctgtaccctgtagcattctgaggacaggcctgaattctgagaagggcaagtggtaaaagtattgtccagtcctttttaagttggtggctgagcttggtgaggtgtgtttttaaaagaccattagtccattctacctttcttgaagattgaggaccgtaaggggtatgaaggttccactgaataccaagagcctgagaaactgcttgggtgacttgacaagtaaaggccggtccactgtcggactgtatagaggtgggaaggccaaaccgaggaattatgtctgacagaagggaagaaatgaccgcagtggacttctcagaccctgtgggaaaggcctcttcctatcctgtgaaagtgtctacccagaccaagaggtattttagtttcctgacttggggcatgtgagtaaagtcaatttgccagtcctgggcgggggaaaaaccccgagcttgaggtgtaggkaagggagggggcctgagaaattcctgaggagtagtagaatagcagatggaacactgagaagtgatttccttgaggatagatttccacaatggaaaggaaatgagaggttctaagagactggctagtggcttgtaacctacatggaagaggttatgaaatgatgacagaatagaatgggcctgtgaggctggaaggagatattttccttggtctaagaaccatttgccttgtgtgggaagagattgataggtggaagtttcagcgggggactaggtgggagtgactaatgtgaaggagaaaaactgacygtgagggacagaagttggaacgctagctgcttttttagctaatttatcagcataagcattgtcctgagcgatgggatctgatgcctttttgatggcccttgcagtgaatgactccagcttcctctggaagtaaagcggctttgagaagcgtttttattaaagacgcattaatgatagaggacccttgtgtagtgaggaaacctcttgcatggtggtgcaggatatggaaggcatatatagagtcagtataaatactgacatgtagtccctttgcaagagtgagggtttgacttaaggcaatgagttcggcttgctgagaggtagtggagcggggcagagcggtagcctcaatgatagatgtgsaagatactatagcatagcctgcctttgctggtgagtggygattaggcctggtggaactgctatcagtaaaccaagtgtgttcagggtgaggaacaggaaaaaaggaaatatggggaaatggggtgaatgtcaggtggatcagagagatacagtcatgggggtcaggtgtggtatccgtagtaatgtgggaggctggattgaagtctgggccagaaacaatggtaattgtgggagactcaacaaagagtgagtacagctgaaggagctggggaacagacagtatatgcgtcaggtgggagaaagaaaatagattttggaagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggcacggtcccggctcttgtgtaagaattctgactgcactaaccatgcctaggaaggaaaggagttgttgttttgtagaagggattgaggtttgggagattagtcagacttgatcagcagggagagcatgtgtgtttttatgagaattatgccgaaataggtaacagatgaggatgaaatttgggcttgactgaagtaatgggggctgtctgtgaagctttgcagcagtacagcccaggtaatttgctgagcctgatgggtgtcaggttcagtctaagtgaaagtgaagagaggctgggatgacgggtgcaaaggratagtaaagaaagcatgtttgagattcagtccgtcatctttaagaagagctgggagatgaaataggaatataggtgaagggaataactttacataaggtctgcatcaatagccccagcgccacttttactgcttgtcaactgcgaacatgtatctcctttgtcacaacaactatggccttagtgacaatgaataactgtcattgttaacacctaatgctccttttgaactcgagatatggcacattttaatacagaaactagaaatgtttattttacaaatattttgtgattttaagatcggaaatgtttmaatcttgaaagcattttccctgatcctctgataaacagatatgaaaactttaatcacatgataaaagagatacgacatttcatttgacatcttcacttaaaataaaatgaggccatgtatacaaatgcatatccaagtttcagaataaacaagtaatgaatgtgaaaatataggaaaaggagtgaattgtctaccttgtagtttattatgcattcatggtaatttggtcttaaaagggaaccttggaattgtatgaatgttatagaaaaatgcgtagaagattattaattctatcattctcatcttttcaaaaattcaacctctttttagtagtactatgaaatcttaatttccgaagataggatttattaatattcaaagaaattattragatccaaagataggattctcagttcatcagtgaggttggggaattattcttgctgttcttctaggatttggcttccagtatataactagagtatgattatccaaaaatttggtcaacagtgggagtaagaaggtatagagaatacagtagaaattgctagtaataagtgagagtgtgaccagtgagggatgtatttgcctcccaggattaaggtatgaggtgacttagtggttgctgctcttgattttggggcggtgggagtgatgtttagtcctggcctactgggtcatgcaataaaaatggtgcctgatgatgtctgtgggagaacaagatggcaaaaagagccagagttggtacaaactttacagcaaatttatttactactaaattctttcaaaattgggtaaaggcctttaacatgtccacaggtgactgtatctgaaaatgtggataataagaattatggaagtcccataaacccttctgagatagttccagagacaaacccaacttcaccagctgctgatggaactcaggtaacagttgccgactcctgaaataatgtgggatttggaaaaactttgggatgactgggtttttattamccttaagcaaacaagggagattctggaaggctcaaagatctcaagatgtgttgacagttaataaatataattttttaaaaagtcatagattgaaaaactttccaccaaataaagctacattctaacatcgagttgggaataatgttccttgtaacataggaggacatgtcacaaagaagaacaaatagacttctggatccagtatcttcagaccagagacatttaagttgagaaattgactcagtatgaataaagatttcacggtgtcaaagatacagatgaaagatccgtctgtgtgtgccgtgatttctctacagcatgcatctttattctttcaagctgttcttcgctctcctgctattacagatctttaccactagatggcactaatttttccattcatcatccatctattcattattggccaaccaatcatctaactaacgttattcccctcgatgtgtcagggatggtgtttaatactggagattgaaagaaaaaaatgccactagatggagcttcttaaacatgcctgcaggtcctttgcaattggtacactatttggtctgcaggaagaaattcaataaatatatttgatattaaactctgtattaatgtatatcattagttttaatgaatgcatwtgcagctataccagatatagctgtttgaatctggacaaactgttttacttctggggctagagtcctcaataatatttctcactgggggcgctattggcatattgagtgggacagttctttgtgctacaaaactgtcctatgcactcagggaatttcagtatttctggtccctgtccactaaattccagtagtgtctcccctaattcagtgtgaccccagaaatcacctcccctccccaacacatgtgcactcactcctggttgagaaccgctaggatctggaatgtctctgttctaagattctatgaccaattttgtgaagtaatgtaaagaaatgaaagtctaagagtagttggaaattttaccattttatacaatctttatttctcaaatttcatagtctataaacattgatatcttggtaacttggcagtctcattatcaccttaaacattggtttctgttctgctgatttaaatcaaaataaaatttgacctaaattgatgctgagaagagtctatatcaaggcttctgtacaccttctcaaattcccttatttcttcttctcatgtcacamacacacacacacacacacacacacacactcatacactcacagacatacataaatattgtctagaaaggaattttcagtttcagatttttcaagggactaaacattttttctttaagctrtattaaaaatggattttgaagattaattttccacagacacacggatgcttgaatgtcatatatytggtcctccaagcctgagtcaaccccaagctagtgccagatttattttatattttcaacattttttctcagtccatctctagtctagtgatcttcttcactaaatagacattttccccagctggtgcaggaaggggactgtggtggggaggctgtaacctctgatctgcatgtctgttatcagaaacaaaatgtaaactgacagtctctttcaaaggagagcagatcttcaccaattgtagtcctttctttctcttcccttttgtaataccttggttcctcctcttacttttttacattagtgaggctgagaccctctaaaatgtgtcttccatgttatgtccagggatctcactgtatttcttccctcctgggcactgagttaacagccagcatgctttaaaagcagtagaggcgcttgggtgagatcacctaggttgatttgaatatgccagagtcccacaaatgtatctttcatccataaatatgttgaaagactaacaattaaaaacatgggctgggcacggtggctcacacctgtaatcccagctctttgggaggccgaggtgggtggatcatgacatcaggagttcaagaccaacctggccaacatagtgaaaccccatctctactaaaaatgcaaaaattagctgagtgtggtggcatatgcctgtagtcccagctattcaggaggctgaggtgggaggattgcttgaacccgggaggcagaggttgtagtgggccgagactgtgacactgcactccagcctaggcgacagagtgagacttcatctcaaaaaaaaaaaaaaaaagattcagttctatcattttccaaaagttacattgatatgcataggatcccccaaggagacaaaaatgaaagtcaccgtccctttcctcttgttagtaattgcttaacttcaagttagccatttcattttgaagcaatgacatctaagagactttggcccgccccacttaactgtaagcgcccagaggcagggctctgacctgaatgtcttcatgttccccttgggggcactatgtacaaagcaggttctcacttgaatgtgggttaaagtgaagacctcttctacttctgtagccctgtgttccccactcctccacaggctggtcccctgctgtcacagagtaagagacaccccataaaacctgtgggctccctcagctcctgttgagagtaggctgtctgttcccttgtctcccaccaggtttttatctggcagtcagcatgacaggcaacttttcagtaaagcgtgggccacgcaccatggtccagggtgattatctttgggttctccagtttatgggcctctgggtcccctgagtaatcattacctgcccttctacctgcaagttagttgtataatcttgctgtgactcagcaagtataggataataagtgtacctacctctggggtttgttaaaaaaaatcagaaacttgtaaaactcttagaatagttcctgacacatagtaagcactcaataaatgttagatgtttttgttattattattgtgacacaggagggaatgatgaagggagaagggatactcttgagttgaccaaagaatgttactttagggaataagagttacagtttggctttgccatctccacccaattttcaggcagccccagaaatctctttttctccagatgcatcttgtgcatgtctgttttatgtgttctctctgtactgaggtaaccaggtgatttgcttgtagatactatggcacaaattctataatatataaatttgaagtcaaagaagtgtttaaaaccattcgattaaaagagcccagagtttcagttactgttcagggaccataggaggaattgaacaatttaccatatgggctgaatcacatggtcccaggtcccaaattgctttacccttcagtaagaagaaattttaaaactgagacaggaggaaaagaaacccacaaaataattccattactgagaggtttttgttttccccttttcatttaggtgacaaaatggaatctcttcaaacgaaaatctaaacaaactaccaactttgaaaatccaatctatgcacaggtaatttttaacaatttttcttagcacagacattttttcttagaaattatttgcttggttaaattggacacacacttagattattctgagcagagtggccacaartagtcttctttatgaaaaaccgtgtatggtgaccttgggggaataaatggctgattcctgttacattgtattcttagatrgagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattaraatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaadggatggatggatggatggatgaatgratgaaacatatactactgattattttattccagagttctcaaaatatttgttgctgatattttgagtgctgactgtaattactttgattagataaacaactggaaataatgctgctgaaaaagttctaataaatgtgtattttatcagatgttttctgtgtgcttcataagccccagtcatgaatcagttgtattttgctgtgtaaaaagcttgaggctttgagtgctcttagtcacaccaattctgtaccactccttcttggaattgaatccagagcaatttgattgaaaatcaagcctctgcattcatttttttgtgtgtccatgatattctggggtaagttataggaaacaaataactctccagaaatgagaagttatcagagtcgcaggtaaccaccagtatagccagtccttgaatgctgtccatggctaaggcagagcagggaggaaaggtgcatattcctgtttctctaataactagcgttcccctaacagtcatttgtcaagaggacaatttcccagccagctccgttaagcatagggtatgggccatcttcccactgttaatctctctgagcctcagctgctgcctctataaaatagggggctcggttgtgagaccccagtgtgggagtgtaacccaacacccagcataaaatataccttcaatcaatggaagccatgactattatcatttatgaagtaaagggaaaatggaacagccatttgtgtgttttaaaaagttccttgggtcatttaacgaagagccttggttgaaaatgacgattctaaatagaaatggctgctctttcttttttagtggaggaggttacagaggtgaacaagattgtgtctgggcctttgaaaggattaacacgtatcttgtctataatgaggctgaagagcagatgataaaaagtttggtcttgctttactgtcatttgaaggtgataggaagggcagtaaacactcctgtacatagaaatgggaaaaggttgagaagacggaagtgcatattcacatcacagcacagggaactgaggcaccgctgaaataaatatacctttcccagattcctccaargatcccgaggagttgtttgagtttgttgtatatattctggatatgagtcccctgtcaagtgaatagtttgcaaaaattttcttccatttaacaggtggtctcttcattttgttgattgtttcctttgctgtgcagaagctttttagtttatcataatcccatttgtctatttttggttctgtttcctgtgcttttgagttcttagtcataaattatttgcctataagaaagtccaggagagttttccctaggtttttttctaggatttttataattttgggtcttacttttaagtgtttaatccattttcagttaatttttgtagatggtgaaaagggtccagtttttttcttctgcatgcagctaccgattttcccagcaccatttattgaagaggatgtcctttcccccgtgtaggttcttgttagctttgtcaaagatcaattggctcttaaatatgtggctttatttctgggttctctattccattctgttggtctaggtgtctatttttataccaatatcatgccattttgattactatagccttgtagtcaggtagcgtaatgcctccaactttgttctttttgctcaggattgtcttggctattcgagctcytttttttggttccatttttaaattttttttctaactgtgaagaatggtattggtattttgatggggattgtgttgattctgtatattgctttggacaatatagtcattttaacaatattaattcttccaacccataagcatggagtatttcgccatttgtttgtgtcctcttcaatttatttcatcagtgttttgtagtttttcttgtagagatttttcacctccttaaatttattcctaggtattttttttgtagctattgccttcttgatttttttttctcggctagctcattattggtatatagaaatgctactgatttttgtatgttaattttgtatcctgctacttgattaaattcatttatcaaacctaggagtttttttggtggagtctttagattattctggatagaagatcatattatcatcaaagagggacaatttgacttcctcttttacaatttggatgccttttatttctttctcttgtctgattgctctagctaagacttccagtactatgctgaattggttaaaagtgggcatacttatcttgttccagttcttagagaaaattctttcaacttttctccattcagcacaacgttatctgtggatttatcatatatgttttttattattttgaggtattcctagtttgttgagagttttcattctgaagggatgttgaattttatccaacgttcttttctgcatctattgagatgatcatatggttttsttmttcattctgttaatgtgatgtatcatgtttattgatttgcatgtgttgaaccatctttgcatccctggtgtaaatcccactggatcttggtgtattatctttttaatgtgctgttggattcagtttgctagtattttattgaggatttctgcatctgtgttcatcagggatattggtctgtggttttcttttttttgttgtgtccttgtctggtttggggatcagggtgatgctggccttatagaatgaattagggagagttccctcttttttggaatcatttcagagggattggtattagttcttctttgtacgttgggtagaattcagctgtgaatctatccagtcctggacttttctttattgggagactttttattatggattcaatcttgctactttttattgatctgctcaggttttctgtttcttcctgatacaatcttggtaggtagtgtgtttccaggaatttatctatttcctagattttccagtttgtcagcatatakttgttcataatagtttctgatgatcttttgtatttctatggtatcagttgtaatgtcttctttttcatttctgattttgtgtatttgggtcttttcttggttagtcttgccagtggtttatccattttgtttatatttttgaagagcaactttcattttgttaatgatttgtatttctttaagcctctatttcatttagttctgttctgatctttattatttcttttcttttgttcatttggggtttggtttgttcttccttttctagttccttcaggtgcgttgttaggttgttagtttgtaatttttctacctttttgatgtaggcatttaatgctataaacttctcttttaacactgcttttgctgtgtcccacagattttgatatgttgtgtttccattttcatttgtttcaagaaatgtttttatttccttcttaatttctttatttacccagtggtcactcaggagcatgttatttaattcccatgtatttgtatagtttccaaaattcctcctggtactgatttctagttttactccagtgtactctgagaagatacttgatataattttgatttttaagaatttgttgatacttgttttgtggagtaacatatggtctattctgaagaatgttccatgtattgatgaaaagattgtatattctgtaattattggatagaatgttctgtaaatgtctgttaggtccatttggtctaaagtccagtttacatttaatgcttctttgttgactttctgtctaaatgatctgtttaatagagtgggatgttgaaatcccccactattattgtactgcactctatctctttatatctagtaatatttgcttcatgaatctggctgctccagagttggatgcatgtctgtttagaattgttatgccctcttgctggattgatccctttatcaacatataatgacctcctttgttttttatttttgtttctgttttttactgktcttgccttaaggtctattttatctgatataagcataatactcctgcttgcttttggtttccgtttgcatggaatatgtctttccatccctttactttcagtctatatgtgtctttactggtacagtgagtttcttataagcaacatatagttggatcatgtttttaaatccattcagccattatattttcrgaatttaatttttttatgttcaaaattattattgatatgtgaagctccattcgttcctgtcatattgttagttgttttctggttgttgtaaatattctttgttctttactttttctcatattgattgtcattgtagtttggtgaatttctgtagtggtaccattgagtcctttttcttccttytttatgtgattactttaccagtgaattttatatgtttgtgtgttttcatgatggtaaatattgtcttttcacctccaggtttagaactcccttgagtatttcttataggtccagtccagtctagtggtaaacaaattctctcagcatttgctgtgtgggaaagactttatttcttcttcatttatgaagtgcaattttgctggaaattgtatcctcggctggcaggtttttgtttttttgttttttttctttcagcactttgagtatgccatcccattctcttctggcctgttaggtttctgctgagacatctgctgttagtctgctgagggttactagatagattactagatggttttctcttgctgtatttagtattcactctttacctttgactctaaacagactgaatataatgtgccattgagaagactgttttgccttgtgtgtttttggggattactgagtctgctgtaactgaatgactaaatctcttgctagacttgggaagttttcatctactcattaaataggttttctaatcctttgtctctttgcccttgaggataccaataatgcaaatattmaattgctttatgttgccccaaatattacaaagattttgtttattcttttaaaattcttttttctttatttttgcrtaactggattatttcaaaagggattctgagataatgagattctttcttctgcctgatctagtatactgttgaagctttcaaatgtattgcgagcttttgtatttccttcaatgaatttttcccttccagaatttctatttggttattttaaaaaatgtattttttggttaaatttctcattcatatcctgaattcttttctgatttttttttgtattgtttttcagaattctcttgtatctcactgagcttctttaaatcaatgtttaaaattctttatctggaatttcaaaaatttctttttgattaaaatctattgctagagaattattgtgttcctctggaggtgtcatattttcttgctttttcatgyttcctgggtccttatgttgctatctgatgtgatggttggtgtaacagttgtttcttctcatttttgaatttacttttgcaggggaggactttttctgaagttgcatctatggagttgcttgggtaggatacgttggctttgattctgagtgcatgctgtagtgtagtctctgtatgatttatttgactgtaaacagcatagtagtatctgtgctttccttagtgagttagggtgtggttattactgaaggctgtggtgaagttgtgttgggggactagcatgccgtgtgtgccaatattcaggccccaatggtggcagctgtgggctgaatatgcctatattttagccccaaggtggtgtacaatggtgcctgtgttcatggttactggtgggccaattcttaggcttccaaatggcttgcttagattccagtagtggcagcgatggaccaggtgagtgggtgggttctcaggcaccttggacagctgacatggcataggtgatagcagtagcagaggtaaggtgattctctgggtcacaggcagtatgcattgatgttggtggtggctccaatggactgggcaggccagtctccaggcctgcatgtggactttgctggttagcaccagctgaggtggtag
